United States Patent 10,858,650 (METHODS FOR MODULATING ATRX-DEPENDENT GENE REPRESSION) - sequence listing, part 4

SEQ ID NO: 7890 - DNA, 743 bp, mus musculus
acatatagttggttaataaaaacctaggaaataaagattagaccaaattaaaattttgtttggagctcgagcagagtccataaatctaagttggcaaaaacaaatgaaagtattttatatttcacttggaattttaggaaagagcactaggagaaaatgcatatttttttttcatcacttgcagggaataaccagagaaggaaaactctgcaatcccattgatatcttggtacccttgccaattgactgggctacacacaccttatataatgagtcttagagacaatcagaaaagtattcccacataaatcaagaaaatggatagcatcaaagcataatgttgttgtcattactggaagtccagggccaaagttacatgtaaattggcaaacaagacaaaatcaatgcaagtgacttgcaggtttgagtctgaaaacctggctgagagagaaagctgaatatcccacgtggatgagggtggcctcagatggaaatgagtggttttaatttaagcagcttgctgttgacagaagggactatctgccatgctcatcacttattagcagtgctgatggcttcacacttgaagaaagtagagagttaaatttattcaggtcatctgtaggcaacaaatatggagacaaagtggcaagggctgtttttcccaaatgttaatgtgcataaaaatattaaaacaagcaggaattttacactatcccacatacaaggctctgttttgagta

SEQ ID NO: 7891 - DNA, 930 bp, mus musculus
cagtataagaagtgtccagatgatcaatatcagaatagtcagagaatttactgtcttccaaaggatgtgaacttcttggcttttgaaggccctttggggatgtctctggcctgcacagccctgcctctctgtccttactgcagtggtccttggggtatttgtgaagcagcaggaaatcccctcggttaaagccagtacatgggctttcagctgcaccctgctgaaagtctggcctccgtcacactgtgcttcctctgctctgccctatgcattggccacccccacacagctacgtggtgactccaacaaatagcatttggagttgtgtttactatggctatttctatcattctgaccaaaaccatcactgtagttctggctctgaaggccagaatgccagggagaataagatggtgattggtatcaggatctcctaattttgccctttttatattctccctaatccaagtggaatctgtctcctgatctgtcagctcgggctgagaaactttcctcccttcattgacacagacacactctctaagcttggatctgtagttctcacacgcagtgaggtttcagcactgtcttctaccatgtcctaggatacctgggctccttgaccctggggagctttaccttggctttcctggccatgggtttgcctgacaccttcaataagtcaagttcttgatgttcagcatgctggtgttctgcagtcacctccctccttgccgaccacagcatcaaggggaaggtcctggaagccatggggttcttcttcatcttagctttcagtgctgagctacttggctgcatctttgcccccatatattacgttactcttatgagatatgaataccttccaaggtctgaagattaaaataggttctggaagcagtaagaattccagagttttatttcaaaaaa

SEQ ID NO: 7892 - DNA, 757 bp, mus musculus
cagccaagctctccgccagacctgagcaagcgaaacttctgggattcataaacttgtggtttctgggtagagtggcgtttaaaccaggactcagtggggaaagggcaacatggccagctcttctccccagcgaatcctcggaaccaaggttggggtccaccatcatcgaaggggtgctgcggaaaaggcacggcccagaaagccccctgaggattgttctgggggtccttgatcctagtccatgtgaaatggagtctccttgtggcatgtaattgagcccagcttagaaaggccagtgctctgcttctccgagacagtgcctttgattgcagagtgtgtgatctgagtaatttaatttatcgctcatcttttgccaagtgatctttttacaatgctgcatttaatgactccacagctggggtagaggctctcctcgccctcccagctctctggctgctgtcttcctgtgactcactttaacaggaggcgggtcaggaggtgcaggaggagagggcggtgcgggagtcaggcatacctagattcctatcttgcttgtgccatgtggccggtgggcacggcctgggaagagttccatccttgagcccgttttctcctctgcagagtgacaatcacacaaatattgattggataaggaagacacagggattgaatgagatcatgaatagcagagaggaaaggaaattgctaacttagaaaacaaaatggcccctgtgagattccaataggctttggggag

SEQ ID NO: 7893 - DNA, 814 bp, mus musculus
cccagctcacctccaggacaaggccattgcctgaccctggccagttcccaccagctccatgttggcggcaacccttcccacccagcccgtgagcccaggcatggctgttgtggctggggaggtggagtgaggggctcagactccagcccacccgaatccccagccccacagagcctgcaccggggactcacaaggcccatgatggggcagaggctccaagaggccggggacacacaaggcccatgatggggcagaggctccaagaggccggggacacacaaggcccatgatggggcagaggctccaagaggcctgcagggctcatggagggtggttggctgaggtgggacacctgcggggggaacagtttagggaggccccaccagggtcacttaatgaccaaacaggagaggctcagcctagactatacagtgactccggggagcaccagaaaagaccctgcccaggccccacccagaccacaacatccacctctctggtggggccagtgtgtggtgggggcctcccgttagaggtagatgtgtgcatgcctggtgcagggggctggtgcagagcattggcaggagtggcgcaggaggccggcggcacctggagctccgcagcatccacccaggcctctcagccacaccgagttccccttcccgcatgcccctaggtctgcacccgctgccccgggccggctacctgcgctccccttcctggacgaggacaagggctgagcagagccacgagaagcagcccctaggcgaccccgagcggcaggccacagtcctggacacgtttctcactgtgg

SEQ ID NO: 7894 - DNA, 814 bp, mus musculus; identical to SEQ ID NO: 7893

SEQ ID NO: 7895 - DNA, 1079 bp, mus musculus
tccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagc

SEQ ID NO: 7896 - DNA, 1408 bp, mus musculus
gattggaaacctgctcatcgtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccgcccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaaccaatgtgagggcctacattggataccgtagtcaccagttacggtatattggaaatccagttctgatgtcatcctcctacgagaggcagtctctgatctttctagcctgaaattcctaatctcagaactcttataacattttaataagttaataataagtgattattgaaattaccactttcaactcattgctgctctttttggcagagtggcagcacagggatatagggcatatgtcctgatgagcagagtcaagttgggaagatctgagcctcagctttcacatctacatgttaggaataataagtgccctacatgggtcacatggtgtgttgattacaatagctcatgcttccaagattataaatcactattcatgtgtccatttttatttgactgttaagtttaatcacccttattaggcttgcaagcctctgagggcaggagttgtttttacacatcactgtaccttcccaatcttggtcagataaagtgcatccaataaatactggtggaagtggaatgaataagatattaatatctgaaacgtaatattataattagggataatcaaaccagacattattttctcat

SEQ ID NO: 7897 - DNA, 610 bp, mus musculus
ccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaaca

SEQ ID NO: 7898 - DNA, 125 bp, mus musculus
aacaaactaggcattggacatatttttagtacagataacaactttcataatgatgcaagcactaagaaagcaaggaacccagaagtggttacggttgaaatgaaagaagaccaagagtttgattt

SEQ ID NO: 7899 - DNA, 3582 bp, mus musculus
aaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaagcttcatattcaacccgatacctgaaaaacaaaattgttagaggccctgaaaaaaagatgaagtaaaccacagacctaattcttctagagaaggatatagaggtttaaatgatttcaagaaatggtgtgagttcagaatgaagaaagaaagaggcaaagccctacccagagccacccatgagaaatctccagccctaggaaagtcttctttcagagagccagccaacttcgtggaccctttcatgctcaaactactagaggtggtttgatattaacaagttttctatttccttcccatcaaatgtaattttattttttaaaatcttcaaatcaggatgacaagtgagatgctattcctgggaaaacaatgatgaagaataaggacaagaagtgatcattccagaaggaagagtggaaattcagctgtgtaaagaacttgctttacatcatgacttcttacctttctagctgcattttcttttctgctattagggcttgaagttgctgctgttgagcttctctctgctttgctatagatttgagcaagttccgagcaccgatggcctacagtattgccagagaaggccatggcttcattaaaaccatctacagcatcaagtcctcaaagtggggaggggttatctgggagctgtgtcagtcttcagagaggaaaagaaagtggagccccaaagcttttgggttaagtcagaaggattaacctactgatcacaaagtgcctcaagaactagacggcagctttgaggcaggtctaggagtattcctagagccagggacacaggcacaatagcacatttggtggtgccattcagccttgtgcctttcaccaatcatactatgtaagccttcatttcttcatttataaaatgaggataagaccatctacatcagtgctgatatgaagatgaaacgaggccaggtgtggtggctcacacctgcaatcccagcactttgggaggccaaggtaggcagttcacttgaggccaggagtttgcaaccagcctggccaacatggtgaaaccccatctttactaaaaatacaaaaaaatggccgggcgcagtcactcacgccttaatcccagcactttgggaggctgaggcgggcggatcacctaaggttgggagtttgagaccagcctgaccaacatggagaaaccctgtctctactaaaaatacaaaattagccaggcatggtggcacatgcctgtaatcccagctactcgggaggctgaggcaggagaatcgcttgaacccaggaggcggaggttgcagtgagccaagatcgcaccattgcactccagcctgggcaacgagagaaaactccgtctcaaaaaaaaaaaaaaaaatacaaaaacctcagctgggtgtggtggcacacacctgtagtcccacctactcgggagggtgaggtgggagaatcgcttgaatctgagaggcagagcttgcagtgagccgagattgcaccagtgcactccagcctgggtgacacagcaagactctgtctcaaaaaaaaaaaaaaaataaagattaaaggaaataaagattggcaaaagttcagtaggttaagtggaccagaagttattaaaatcttaaataaaaattcacccacccagccctctacccctctaaataaatcaagagggaagagggatgagagggtagtgaactagggtcccaggccaagatgtaggcggaagacatgctgatcttaccttcatcttttcattttctgcttcttttgcaagttgatcaacaagctcaattaaaccaccaactattttctgaaactggccaatttcttttaggaaaagaacaaaaaataaaatatttccttagtatcatcactccccttcggtagagtgctaaggcagtgagagggcagagcggactgccccttctaatttgtgttaaaatagttcggtgtgggccaggcgtggtggagagcaactgtagtcccagctactcagggggctgaggtgggaggatcacttgaacccaggagttagaggatgtgtgatcatgcctgtgaactgccactgcattccagcctggggaacatagcaagaccctgtcgcttaaacactttggtgcctgttggcctgtctcctacccttggtctgaacctagagaagggtggccagctggaccagggcatactcggaccttgcatccccactgagccagccagccgctatgacctccggctatgaaagcactaggcccttgctgggctcattctccagacagaccccaaccctgcttccccaggagtgacaggaagcactgttgttcacaaaagggcagcctcaggacacaagcgctgcctctggactagctacaggtatgacaccagatttcaattaacagtggggatgggggcttcccacttgtaaccacaaaaaagcaagctcacagcattaagtgcctaatctcccactcactttctccaatgtcctggatgtgacaatttactgaggggaaactaaggcccagagaggtgtgtgcatggcacagcaatcacaggttagtgacagaacccaagctacctttcactaaccaagctctctccacaacctaggaaaccccccagaaagctcagaagtcccttgttctagctagatctggctctgtacgggcattgggcttgcttggctgctgggacaggaggcttcctgaagatttccagccaaaagatgacttcagtaagtctgttgagctgcttctagaaacttcacctatcacttctaactccaaataacagagaacctgcccctgagaagactttctctgaagaaatcaaatcatgagtacataattctatttcccacacccaagccatggttgtgttcccagaaagtttaaggtttctaagagcaagaaatgaaagatggcatatctaaagacaccctcccctccccatcccggtgtttggtttgactggtgccctgttggggacacatgagagcacaagagggcagacagaaaagggtggcacgtgggaactcacagacgccagattcaacctccagggagccagcagctccactgtggcagggccaagatgagcctggggtacagttgaaatggcagctcaaagctgagtggcactgtatctccccaatactcactgtccacaaagtctttgcactcttccttcagctctatggtctgctgggtaacctctgggtccaacaccctcagcttgttcagttcatcaaagtgtagccctgcttcacccaggat

SEQ ID NO: 7900 - DNA, 3582 bp, mus musculus
atcctgggtgaagcagggctacactttgatgaactgaacaagctgagggtgttggacccagaggttacccagcagaccatagagctgaaggaagagtgcaaagactttgtggacagtgagtattggggagatacagtgccactcagctttgagctgccatttcaactgtaccccaggctcatcttggccctgccacagtggagctgctggctccctggaggttgaatctggcgtctgtgagttcccacgtgccacccttttctgtctgccctcttgtgctctcatgtgtccccaacagggcaccagtcaaaccaaacaccgggatggggaggggagggtgtctttagatatgccatctttcatttcttgctcttagaaaccttaaactttctgggaacacaaccatggcttgggtgtgggaaatagaattatgtactcatgatttgatttcttcagagaaagtcttctcaggggcaggttctctgttatttggagttagaagtgataggtgaagtttctagaagcagctcaacagacttactgaagtcatcttttggctggaaatcttcaggaagcctcctgtcccagcagccaagcaagcccaatgcccgtacagagccagatctagctagaacaagggacttctgagctttctggggggtttcctaggttgtggagagagcttggttagtgaaaggtagcttgggttctgtcactaacctgtgattgctgtgccatgcacacacctctctgggccttagtttcccctcagtaaattgtcacatccaggacattggagaaagtgagtgggagattaggcacttaatgctgtgagcttgcttttttgtggttacaagtgggaagcccccatccccactgttaattgaaatctggtgtcatacctgtagctagtccagaggcagcgcttgtgtcctgaggctgcccttttgtgaacaacagtgcttcctgtcactcctggggaagcagggttggggtctgtctggagaatgagcccagcaagggcctagtgctttcatagccggaggtcatagcggctggctggctcagtggggatgcaaggtccgagtatgccctggtccagctggccacccttctctaggttcagaccaagggtaggagacaggccaacaggcaccaaagtgtttaagcgacagggtcttgctatgttccccaggctggaatgcagtggcagttcacaggcatgatcacacatcctctaactcctgggttcaagtgatcctcccacctcagccccctgagtagctgggactacagttgctctccaccacgcctggcccacaccgaactattttaacacaaattagaaggggcagtccgctctgccctctcactgccttagcactctaccgaaggggagtgatgatactaaggaaatattttattttttgttcttttcctaaaagaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactacaggtgtgtgccaccacacccagctgaggtttttgtatttttttttttttttttgagacggagttttctctcgttgcccaggctggagtgcaatggtgcgatcttggctcactgcaacctccgcctcctgggttcaagcgattctcctgcctcagcctcccgagtagctgggattacaggcatgtgccaccatgcctggctaattttgtatttttagtagagacagggtttctccatgttggtcaggctggtctcaaactcccaaccttaggtgatccgcccgcctcagcctcccaaagtgctgggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaacttt

SEQ ID NO: 7901 - DNA, 992 bp, mus musculus
tagctctgcaggcctgtggtcctcagccaggagagtctgcgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgttcaggcacagcccgcaccagagcaaggggtgaaagggcatctcctgaggacttactgagcttagggatctgtgaccccattttttctggaaaaatctctctttgctgggtgtggtggtgggagtgcttgggcaccacccctgtgcagtccctccttctgccctaggggcaagacgtgctgtccctctgagtttcatctccctcaatttttctgtaggttggcaaggccacaggcttcctcaagaactttctgatcgagcccttcgtcccccacagtcaggtatgtgtgaggcggctccaggctgggtcttctccctcctggaaccttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttc

SEQ ID NO: 7902 - DNA, 1235 bp, mus musculus
ccctcagcagttgccaagatttgtccccaaagctcagggctggtggtcaggtgggttagggatgagttgttaagggttgggagaatacatctcctaatgcaatgaggaacagatccagctgggttggagggaagggaggagggcctgcgccccctcagcccccttcactccccacctctgcacccctgcctagcttcttaaccaggaagttgagctaccttcactaaagaagagtggagacaggagacccggcccttctctctgggacaggactctcctggtggggctcctcagaggtgagatcctgcctctgggcccctgggagaccctggaccttaaagttattgtgcccacacattctggatggggcctgcgaggatggtcagggtcatagtgccacctgctggggctcccaggaacagcagctggagagacgctgacgtgtgtgtgtgtgtgtgtgtgtgtgtgtgtgtgtgtgtgtctcggttgtggtggtggcggggcaattaataacacctcaccacagatcttaaaattcgcctgatattgaacccttaccccctttccaaggaagcagccaaaagagtgcggaggaagtgatattggaattcaactggggctcccagggaaatccagggctgcagggacataattgcattccttggaactgctgttttttgaacttcattcatgaagcctggtttctagggatgctttctcttttcatggacccagaaggaaagtggagatggttcttcatgcttctatgtgaaatggggtttcaagggcaaaaaacaagtaagcactttgaatatctttgtgtttttttacactgataagaggaagaaaagtatgtcacattgtaaatgtcgatgattagaaacagtccaaggtgatcattgtaatgtcaatttctgaagcagttgggagaaataagtaggataatgaaatgaatcagcacagtgcctctcacttgctaaatatgccgcatgttgggaaattcattgataaaatgaaacccactgtggagaaagtgactggccttcctggcaagccaggctggaggtgagcagggttggccagggtcatggggtgatgtcttggttggaagccaccaggtgacctgtgtcctgttgacacacaagtatgctgcttagtaactccctggaattatttttaaaaagctagatgtgtgaataaagaatttgggggattacaattttggtttgtaaatg

SEQ ID NO: 7903 - DNA, 1594 bp, mus musculus
ttttttttttaaagacaattcactgtacacattttatttacagttttgtacactgttttaatatgaatgggactgcttttctacttgagccatttttaaccaaagcaaaataacctaagtaatacaaagtgttaaaatacagcataaagatacaaaaacagacatactaattctagttaggaatgtaattatgatgttacattttttataatccacaattatgtttaggaaatcacacaaacatagatcactgatttgaatgaaatgcataaatttgtagcaaagctttgtagttacaaaaaacaaaaaaaattaccaaagaatgcacaaaattaatgtttattccacctttgtgtcatattcctggatccttcaccaatgttacatgaggaaaaaaacaaaagcaaaacaaatgaaaaactgaaatcagaatcactaatattatcaagtagggaaacaaataaattaaaatctagcagccatcagcaagagtacagcaaagacaatgctgtaaaaagaaacaaagaaaattgctagaaaactgtatgcatcataatctttcaaaccagcaaaatatgcttctgcataaaatggaacaacagaattttttttcctgtaaagtatagaaatgccaagttgttttctgactattgtggataggtaaaatctgtatgtaattaatggtaattctactgaactattacagagtgggccaggaacacatttatggattctggagatgtgtactgtaattctttgattgggatagtgtaaactctagccaaaaaaaaaaaaaaaaaaaaaaaaaaaagaacacagaagtacaagacaaaggcgaatgagacttctcttatatctgagtaacatttagatggaaatcaaatttaaatgcagtccactctgctttttgaagaggctttggttcagctcccaaatctcgattgcttgacgcagtctcctatgagaatactcagaaggtgtcttcttaaacaacaaacctatttttagtggtggagccgctcttagtagctgtgtctgcgtgggactgataaccaatcactatctttggaggaagtcctaacctttccttgtataccctccctatatgtgtaacagcttctctgttttcacattcagtagtccatattgctatcttatcacctttagctctaacattaacaacagcgccacatacatcatcactgtagtcatcaaaagattctccaataaggcacagaagtgtctctagccaaaagcgatcgaggtcacttcgtctctgctgtttgttcaatgtaattagccatcgtcctccccgtttgtttttctcatcttcccacataggctcaataccatccttaaaaagtgagtagtcacagccaggcattaaattactagacaactggatatggttgtacagagcccaaaagtcttcaacagtatcaaacttggagatcagccacaagtttgcttgccaagttttgcttttatcatttttaaaaaaccagagtgcccatctgttctgtaggggatgtttaatatagtgttctgggttagcaacctcctgattagattccgttttctccttttctgtagt

SEQ ID NO: 7904 - DNA, 1294 bp, mus musculus
ggggttgataggagactgccaggcgccgcttaataggattttaattatacagctccagcaagaattttttcccccctgggcttgagccctcacagatacctccatctccacctcagcatcttcccagccctggcagctagctctcccaggcccccgctgcctgccctccacccaccgtgggggacgctggcccatctcctgggggctcaggaagggcctggcatctgcccccagcaatgatgcagagggcgcctgctcctgggggggggtcctggctccaggagctcctctgagctctgcatccaggactggggacggtcagagctgactctggtgcagggcagagatggtgcccctgccattcaactcactatggactcgatgctcatttttccagagtgattctgccccatgccaaaccctttcgcgatgattgtctcatgtgacgcttacaattctgggagccaggcaggacagatagagtgatcatctccattttatggatgaggaaattgatccccaagagttgaagtgacttgcccaaggacatggtgagtaaggagtctggacttcccgcaggtttgcttgactctgaactccaggttctgtccatggccctgagctgccattcccctgagctccacaccccacacccctcacccctccagaaggagctaagggcagattctcctcccttatcctccaagaagtcaggggcttcttgctctgtttgaaataaaaagcaactgcgtctgcgcaccagtggcagagacggactttgtacaagcatcggggtgaaatgaacattcttcaggcatgagatgttacctctccccatgtctgggttagggtccccgcttcatgctctcacaactcctgaattttggcaccataaccccatcacactgtactggattggctagcaggctggcttaccaatagcctagaatttccttgacacgtcaagaaaaatctccctggtgcccactggtcaagcatttagactgtccccacccacctgcgttctgcaacaagaccccctctcctgcaggtggcctgctccccctgtacctacccatcaggtgatgccagccaccaatgtgtcaggataaccacacgggctttcttggaggcagcagtttcagtgaggcatttttttggtgtgtttattatacaattttaacacctatattttaattttagaatagttttagatgtacagaaaagttgcaaatagagaattcccatacaccccttacccaagtttcttctattgttaacatcctatatcacc

SEQ ID NO: 7905 - DNA, 504 bp, mus musculus
gataataaactagagagcaaacttccctacctataaaatgagatacttgagcagatattttggtcatctcttccagttctactactttttatagttgaaaattttatcaatcttctcccaccttacatttctcatatgccaaaagcagagaagttttgttatagaggatgtctcttgggtttactcagccctacacttttctcaagtcacttctattcaagtacttgactctgttgctgggacactggttcattagaggacactgtcgtctgtccctggtcctgtcccatgtggcaatggcagcactgaagtgtgtcaatcagacaagaaagatatttcaccaaatttgctttggtctgcacttggtcactgaatgtcagcttcatttcttccttctgcagccttagcttttgttttgagatccatcaaactttctttcccaggctgaattaaatgttcttattcctaccaccagcctctgtagcctgcaactcagcaaagctt

SEQ ID NO: 7906 - DNA, 360 bp, mus musculus
ctatcaatcaaatatgttacataagcttaacccacgcaccagaagatggaaaaacaacaacaaaaacacagggctgttgagatttattgaacatagatcacatcaaagacatatagctgcaaagaatctaattaaaatttgttatttcagctggtcagccatattctttctgtacaattaggggttgtgattttatttaaaccaagttccaatactccctcccactcccaggtcactgacagagcagcacttggcaattgggaggagaatatagacaacacttccctcagcattctttctgggatggctgtttgggctaaaatagcagcctctgcttcacatatgttatatctgtctata

SEQ ID NO: 7907 - DNA, 1233 bp, mus musculus
cactctctgtatctgtatctttattattctttctctagacaaataggtgtttaaatagatgatataaagtatatttgtatatagtgattgtactaaacttgttaaatcagtatacaagttgttttcttttttcctaccatttccttcacatatgaactgttgaatttatttatcctctctctctcaacattttgggaggatctcattactctagtccctttcgaatgtagtaatagtctcaattttaggttttaaagtacaatctaaactacatgaaatcgccactctatttttcatctattatagtgatttttacatccctgaactcagacctgatccttagcttgggtgcctgcagtaagaaaatgagctaagatttattgttaactcttagtccactagttctcacctcctgcttaggttccagtagagttggagagataagcagaggcaactgaaaaaagagaatcaaacccacttcttagttggcagatgttacttggccatcacaccttctgttagtctcactgttgacgcttcataagggcttggaggatcctttagagaccgcatgcccgttcataccgcatccttccttgatgagaggtgcactctccacttgatcccttttatccctcatctcaacaccctctgctctcacacactgggcctccccatctcttgcttctctatgctagtgttcttttaccctggcaagcaactctctttatgtactcttgaagggatctcacacatttactttctcagtgtctcctcagtctgtgggaaacattgtatatctctgccctgacaataggtcttggttgcttccttccactgctgtcctctctccttgccttactctgccatgtgtctactccagctagtcatctggcctcaggcttctcttggggagaagcagccacctaacctacctctctgaccccatattgctccacatctggaagacacatattactttgtcctaggatgttgctcactaagctgtgcttcattcccttagtgtcacaggggcaaacagtggtatgggtgtggaataagatgatgacttttgtttcctataaatactctcatctctgtgaatatttatttgggaaccctgtcagctggctaaaggtggtagtgggaaacaccttgcttcccatgggtactggagggaaaataagaaactctcacctcctagaaattctcctgctttaatgaattatccct

SEQ ID NO: 7908 - DNA, 4024 bp, mus musculus
atttatatgtatttggttcaggtgtactataaagattctttatataatatggaaaatttcagcttaaatttgacattcaaatttaaaacaaaaaagaaaagaaggaagaaatctattgcccatcagaagtttgattttctaacttagaaaacaaacaaatcaaccaaagcataaaaaccaaaatcatgtaacttcctgacactagacattgaacttagaaaacactaagttaaaagaccattgttggaaaccttgcatttgtatactcttggagaattacttatcctctctgagacccagatttttaatctgtaaattgagatctttctagttgcaggaaatgactaacaataagaagtaaaaggaatagtaaaatgcttcttgctgagtagaaccacaatgtagtttgatgatttctaatacaatataaaagggatttgttagactgagttacttttacttccttgaaggtttgcaggagtacaaagagtgactagttaagagtgagctctgagaattgtgcccccagtttgtttcaggcagctctttcttcaacctgatcattacactcatgtactgatcagcactcaaatatttgaggaggcggatattcaaagctcttctgtgttgctctctcctgtctggttttcttccatgaaaattttagctacccctgcacactcccagctccttttgctcaactgtgtgagaccactaggcccctcttgagttccctctttctgaactgcaactcaaactctttccagacaggaatttgggtaaataattgggcttactttgtttattttctctatctgagctatcactgtcccatgctgcctcacttccaatatctgaaaacttttatgtattttgtcccattcttttacttgtttcaaataattgtgcaaatccagttcccgttattccttcttaacttaaaaaggtagtcccatataacagataatgggatttatgtcaccttggattcctgagtgactttatgaatcatggtccttcctagccttaccctgctaacttgtttggatctgttctccaagcaaagaatgaaactgctttgttttgtcaaagaaacaatgagtttaatttattaaacagcataaattactctgtttttcttaacatgaatagtatgagaaaatgatagtagttgtaggtgcattgcttctctcacaccatgtagatattgggaaagtgaagggaagaaacatgagtttcttcttcattctctaaatgcaaatgctctccaagtactgtcaattattttttcttatatttttaaaacatcacattactttttatagtggtaaaatatcccccactgttttctgtgtctttattatcatcctttcgctcctaaaatattttaaaaacatgtactcaactcccagaaatatcttcagactcaatactactgcaaccttacatttacaaaggttaatactaagtcttgggaggatcaagtggattcacaagtgacttaagtgctttccaacacaaaggttaattcactttattgaaagacaacaaagtccagaatcttagtaacatagcatacataacgcccagcttacaataaaacatactacatgtaagaatcagaatattgacccataatctggaggaaagagtcaagacaaacttagccagaagtgataagggtaatgaaactcatgggccaagaggttaactcaactattttaaatactttcaaagatttaagtaaaaaattgacataatgagtgagtatatggagaaatgaggcaggataaagcaaattatttatacttaattacatattttatatatatatatatataattaaaaataagtgcttagaatagtgcctaacatttacttaggcacttagtaccaaaatatttgttaagtaaaaatatccaaatggtttttctgccactcatcaaaataatcaaacccaatacttatactcaataaatgcttatactcataaattatatgttatgcctcagtttattttcccttgttgtgtggcactctgtatgataaattaattttatttcttttcaaaaccaaatttaagggctctacccttaataaaggaccccacagttaatcttataaaaaacaatattctaggtcatcacacattttctggaatttatttgctcattacttcatttattcagcaaatgtttgttgattacctactaagtactgagcacagtgttagaaaataaaaatgctctcatgcagcttacattttatcgagggagagaaaaacaaatgtgtacataaattaatgcattaattttagaaattcaaaaagacaataagaataaaacaaagtaatgtgagttcgactggcaaggagtgaggaataatttaaattggatcatcagggaagtatttgcttaggcagagatattccagtgacacctaaattctatgaaaaaccagaatgtgaagacctggggaaaacatttccaataaagggatgaggttggttcatgttacaaaagaggacaaataccattggtgtttgtcactattatcagtcaggtctagtcaggaaaataggaagaataccaattattttaataagtacaaattaattttgaaatattctaatgacgtggtagaagactacacaggcaaaaaggaattgctgtattaacacagaggaagctactgcaggaggcagttgctacttttagggcagtgagaaccaaaggagtagggttcatacaagttcaaggtctggaagaggggccctagctggggctataggttttgagggtcccatgtggctgtattggactctctgaggggtataataaagttagttctgggaatatgaataaaccctgaaaactagaaccaacccgccactgccatggggaggtggtgttgctggggtgacactgctaagaactgtcagtaaacaaaaaggatcttctctgtctccctctttaagctttccactgtctttcttgtacatcatgttggcaaaacttaactgggagccagatagtaaggcagaagtaccttagcatagtttcagtccaaggtgagacatggcatcttaataaccatgacagggctaaagtagagttatcacaaggaaatagaatgctattgtgagcatcatacccatactgctactatgaaatacagtcatcccatggtgtctgtgggggattggttccaggaaccctgtagttactgaaatccaggaatactcaagcttcttatataaaatggcaaaatattttcatataacttatgcacactctctcatatgctttaagtcatctctagattactttattacctaacataatgcctacacatcacttcatttgcatggattcaacatagtatttagtgcacgccaaattcaagttttgcttttcttttggaacgttatgaaacttgtttttgaaatatttttatctgtggctggtggaattcagggaagcagaatacagggatacagaaggctgcatgcagatgctattgtgggcaatttgcaaagagtatagatgctatactataaataaagatatgataggaagatcaccaagagtcttaagtatatttgatttatatgtggagaaaatattagattgctacatgagaagtagattggaaagtattaagatgggaagcaatggaatctagtttagatggaattgcaataatccatgtgacaagtgtgacttcaacctgattgttttcagaggagatagagagaagtgaataaattgggttatagtgcagaagtttctgtggaattagattaggaagatgaggaaaaaagatgaagcaaggatgatcctcttggtttttaatttgagcagttattggaatgggggtgatatatgatggaatgtagaaggttggtaggagagttctctttcgtatgtgttaatttttaagtgcctgtttcacatttaaggaaaaatgttgattgacagctgaatatattattttggaggttgaagaaaatatctagctagag

SEQ ID NO: 7909 - DNA, 501 bp, mus musculus
aaaatttcaatagccttcaatgctgagaactaaaaagcccttgttatctcatggacacccacacatgccacaacagaggacccctgcagtctttgtgaatgctaaacccagctgacagctgttccagagcccatgatgatatgtcccccaaccagccagacctttcattgtaccacctaccagagccagagccaccactataatctttatcctcggatggagccctggcactgcctgccaacatgtatatctaaaccctggaccagatgttgctatacacctctcttagccagcacccctgcatctacctataggcaagatattttctcaccaaagccagtccatgaagtcaggaagaagtgactcccctttcaagtgcacagacaagtgcacaagggtataagaaatataaaagcataataacaccaaaggaaaaaaaagtctctagaaaagaagttccaaagaaatagagatctttgaaatgcctgacaaagaattcaa

SEQ ID NO: 7910 - DNA, 915 bp, mus musculus
gattcacgagtatactccaatcaaagatagtttggttttatattttatgcataagtataacaccatgctatatattcagcaaagacatattactttttctgtcacatgcagggatataaaacacaaaaaatacttactccagcaatgatgtctttcagttctctctgaaaggtagcatatgtatgaattcacgaacagattgcaagttaaaaatcttacattctgtcattttcagtgtcaaatgcatccaatgccaaacacatcaaagatagtcaaatcattatgaaattattggtaaggctctctgttgcttttctatcggtaccataacaaattatcacaatcttagtggcttaaaacaagattcatttgttacctcatatttccattggttagaagtctaagtacagttggaacctctgtgcaacgtcttgcagaactaaatcaaggtgttggatgggctggccccctttctggaggtcgtagggaagactctgttttcatgaccactcaggttattgaaaaaatccaattgcttgaaattgtgggaatgaagctcctttcattttcaagcaaacaaacatagggataaaatttgaatctctatccttcaaatgtccaatttcccttatgctaccagccaagaaaaatcttttaaggactcatgtttatattaagcccatatgaataatccaggataatatttgaatttttaaagtcaagtaattagttaattatatctgcaaagtacccttttctgtgtattcacgggagtaacaccaggaggtcaagattatgggtgccagaattcttcttacaacaggctcttaacttgaaatgagtataagaaattatattgagcataaaattctccttccattattttaaaaaagtattgccctagtagtgagttga

SEQ ID NO: 7911 - DNA, 1344 bp, mus musculus
gatggaaaggaaggaatggtttctgaattagaaatttaaagggtactacttttagctttttctaaatcctttacaattattttagctttttttttttttcttttttttgagacgaagtctcgctctgtcacccaggctggagtgcagtgacacagtctcggctcagtgcaacctccacctcccaggttcaagtgattctgccacctcagcttcccgagtagctgggattacaggcaccagccatcacacctggctaatttttgtatttttagtagaggcggggccatgttggctagactggtcttgaaatcctgacctcaggtgatctgcccgcctcagcctcccaaagtgctgggattacaggcgtgagcaagcacctagcttattttggcttttagtggacactgtctaacaccctccttctaaagatctcattaatttgggggctttgattcattttctgtgaatgaggaaatgtctactgacaaattagtaagatctaaggctcactggatgaggtgtcagggcaatttctatgcaacttcagactagataaggagaatatgtgtaggctcctcactctcttttacatgtataagaattctgggcattttattcttaatgaggctacaatgaagaaaccaacagaggacttaaaagatgaaatatggacctttttaaatattttgcccccaaatacttcttagctatgaatgagttgtaaggtattgaaattactagattgcactttaaagctgtaaccatccatgtgacaactggtttggaatattcattacctagcacagggcctggtatttgtagggatgataaatatttatcgaatgaatattgttgttggcagtctgcggaagcaattgatggggaaaaaaataagggctttagtatcagacagagctagcttctaatgtttatgcaaccacttttaagtgtgaccttggtagtggtaagttatttcaatactctctaccctctattcttgtacaaaaacaaggataataatttctatctatctccccagattgttttgagaattgaatgaaatttggggtaaaaagcacctagcaaaataccttgcacataatgagtgcttaacagctgttagttacccctccccttccttattttatactattgctatttgccaatggaggagtttaaaatgacagtatttacacaactgcagatggaaaccagtagccaaaacctacacctgtgccactctctggccagtcaaaagccctgtgataggagcagagacattgcattgatcatgagcctgagacagcttgctcaggattttctgtaaatacctacaaagatatg

SEQ ID NO: 7912 - DNA, 347 bp, mus musculus
atatataggattttgtggtttatatttttacacattttaagaggcagaagtttctagcctaaatattataggaaatgtttaattttaaaattgtattagtaggcacttgttttcatctagatgatataatgcatttctgattccacttacagaatttcacattcactttttttctttctgttttttttctctctctaattttaggatccttgtcgtagtcttgcaggagaaaattgctgcctttgatagctgtactttcacgaagaaattctttgttacaagtatgtaccaattttttttcccttcttatgcctttgggtttatactacttacttgacacaatcagc

SEQ ID NO: 7913 - DNA, 369 bp, mus musculus
atgctactgattttttgtgtgttgattttgtatcctgcaagtttactgtatttattcatttattagttctaacagttttttgttgtagtctttaggggtttctatatataagattatgtcttcagcaaacaggggcagtttcacttttttcttttctatttggatgctttttatttctttctctttctaaatttttctggcaaggacttcagtactgtgttaagtggacatagtgaaagtgggcatccttgtcttgttccagatcttagaggtaaggctttcaattttttcaccattgaatataatgttaagtgtggtcttatcatatttggcctttattggccaaatatgcagtacatttcttctata

SEQ ID NO: 7914 - DNA, 989 bp, mus musculus
gcattaagccaagtggttttccctgtctgtctccatgtcttgcatccaacccagcctccctaccttccccatcctagctccaacaggaaggggatctaatcacagccaaatctcccaggtgtagattttgtcagagggcaataccccataaatgctacaagacttccggggactctgttctttgcccccaagcaatggtgaatagtggcttccaaaggcccccttggagtctcaggtcatcccgcaggcagggagcccagttgtgatgggtgcagtcccttgagaggccaggaggagggtgtcttgtccttcagaagtcctgttatgggccgcggtccccctagcacggaaggctctgtcctgatgaatgtgtggaattggctccacgactcagcctgcagatctgcttgtcacaataatcaatgacgcctcaggctgtgccacccagctccgttttacttagaagtcggtggaacagtgggattcctcatgatggcttcattcagcactccagcaggcctgtgggcacaggacgggggtaggtttacacagatgctagcctctctggcaccctagcaggtgtctgctaacctccctcagaccaccctcacagtaaagagcccctctcgggtttgagatatgagagaccagtctctggagtggccttgggggaagggatctgcttcctgcctattgtccacggtttggctggtgggtgaggacttgtgtccacgtgggaggatgataacacagggtccagctttggcagagcacgtgggtgcttcatgcaacactgcattgattagtcctggccgccccaagtggtattatatgcccatttagccacgaggaaacaggctccgatcaatggcgtgccctgccagaggtcacaaaaccagtaggtcacagacccgggtcctgatcagcagccttttgcccatgcttggactgctgcaccacctgtaaaaacagatcggccccttggaggc

SEQ ID NO: 7915 - DNA, 1055 bp, mus musculus
aaatgtaccctaatttatacttttcaataattcagatggggcaatgggaattactaaaaatgcctatcttaaaatttaatagaattttacattttaacaaattaatgctaagaactgaaataccagcatactggaaagttaaagtcacgtaaggtatgcaggcagcactctggatatgtgctttagactcggagcaacagtcaacgtacccctcaacccaaaacagagtcactacagggaaggactagggagggtgagcaaaggcccatcctcccagcccttaggagcactgtattctgtaagataagaatgagggtgggggtaggaaagagacccaacctccctgatagagaccactgaaaggagctgctgttaattagcaggcaccctggttggtgacaaaagcaagagtccatgtttattgaggatcccctctagtttgactttgtgctaaagaatttacactgggctatcttaggtgattcaaacaacagcttatgatctacttatggtcctcattttggagatgaaaaaatggcgatctattgaggtgtagggtacatctaaggtttcacagtcaggagggggcagagccaggacagaagcccagatttatcgttttcaaggccagagttctaaaccacggtgccttactgcttctaaccttacatgaagtcaccactgcccacatttctggccgtctcagagaggcccaagcacctacagacaagcccatgggctttgaagcaggcactgagttccgagcataaatattaacataactgtgtgggggccacttagtgacaggaactttcaatggaaaaggtggttgctcttttccaagcatgatatcttatagctggggtgctgtaagatgtgagagagggagagtcaacaagattgtgtgcccagcacaaggaaggcactcagttatgtcgtagaggtgagaaaagagaagcaactttggcaggaggggaggaggtaagaaagattcctggctactgagcttgagatagcaggtttcttctttctacaaacatgtatgcagttcctaa

SEQ ID NO: 7916 - DNA, 1763 bp, mus musculus
cattcaaacaaatttgaaggagtcgagtgaggcatgttgatattcggaggaagaaattgctgatagaaggaagagctagtgcagagaccctaatgcaagagcatggctggcattgctagaggacttaaggaagccagtgtgacgagaacatagtggacatgggggagttggaaaagacattagaggcattccaaggcctggtcatgtagggcctttgaggctgttccaatgactttgactttaactctgagtaatgagagagtaagagggtattatgccatgaagggacatgatctgacttaggctttaaaagatcattctagctgcatgagaacaaaggtgggaaaccaatgagaaggcaactttggtaatccagatgagaggaaatgatggtggcttagaccagagtggtagctggggaggtgatcatattctggatatatttttaaaatatactttaagtaagagtaaatatgattttctgatggatttgataggggtcatgagagccagaaagtaagccatagataagcttcgtgtgttagtcagggttctctagagggacagaactaataggatagatgtatatatgaaggggagtttattaaggagtattgactcacaaggtgaagtcccacaatgggcctgtggcaagctgaggagcagggaagccagtccaagtcctaaaacctcaaaagtagggaagccaacagtgcagccttcagtctgtggctgaagacctgagagcccctggcaagccagtggtttaagtccaagactctaaaagctgaagaacttggagtctgatgttcaagggcaggaagcatccagcatggcagaaagatgaaggccagaagactcagcaggtctgctctttccaccttcttctgcctgctttattctgtccatgcaggcagctgattagatggtgcccacccagattgagggttggtctgcctctcccagtccactgactcaaatgttaatctcctttgccaacaccctcacagacacacccagggacaatactttgcatccttcattccagtcaagttgacactcagtattaatcatcatagttacacacaggaaaacatggaaaaaatatgctagttcatttctctgtgagatgggatatgtgaattttgaattgtatttttctgtatttcgaaatgttctctattatgcactttgtaagctgaacagtgatgcacagaagtcaacctttcgtcatactgttgccttgtccctaagtcctagggcatctttagcctgcttcctattttctgcccctgggagaccagaatcacaaagaaggtgtgctggccctttagccctggcatcacattagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggtaagaacaag

SEQ ID NO: 7917 - DNA, 1763 bp, mus musculus; identical to SEQ ID NO: 7916

SEQ ID NO: 7918 - DNA, 1763 bp, mus musculus; identical to SEQ ID NO: 7916

SEQ ID NO: 7919 - DNA, 1180 bp, mus musculus
aaatgctgtttaactgcctctcctccttccaccgctatcaccccatttctgaaggagaatgtggaaaggtagagggcagtttcttgactcaagcccagctccagacagagcctgggaaaaaccaaatgagtaaaaatcatcagtctccctggctcacctgccactagcatctgtcacctcctgggcccagggacacaggaaggggctggatcttcattccagctccccctttcctccccaccatgagtccacatggaagcagcagcatcagacggtcagcattgaagccacatggccccgggtttgagtccagactcccacttgtcagctgtgtgtcttcagacaaattgcctaacctctctgaactttgttgttcagagagcaatttttccttcattgttaagttaggagcatcatagaatcaaccctggggttgtgaagttatatgagaaaaaacatggaaaataccccttctcgtgcctggcaccttatagatattcaaaacatatcatcgctttctctctatttccatgtttcctgaaccatggaatttttcccagaagacataagttgcccaaattttgtaagctgccccaggtcagctcaccagcctgcagggtccaggaatggaagaagctgagcaccccccagtggaggccacggtgttatttcctcacctctcagaggcagggcgttctgaatggctcctgtgaactgcaaaatcagagactgaggctctcagctgggagctgaaagagggcctagcacccaggctgtggctgggctggggatggcagccacccaggtgtgtgttcccaacatcacattttctggcacagtgactttgccaagtgccctagcctggccccaaggaggcagagaggaactggggaacttccagtagcctcaggggtgggaactgagtgcccagattgatactcaggaacagagacagcgctcgtgggggttgtgactgaccctcgcatctccctgtcacttaccgacacctgccgagagccctgccgcgtcaggtgacctcccagtgtctcagggccagggccagggtagaggaggacaaggcaccggagtgaaaaccatcaggattggagtcaggggacctgtggcctggtcctgactccgccactcaccatctggacagtctttggcttgtcactcaacc

SEQ ID NO: 7920 - DNA, 1163 bp, mus musculus
tatatattttacttaacttcatagtattttacttattctaaaataggaagtcacagtggaattaattggaaacatttgctccagattctttgcaggtgtttttggcctcatttttccccctcgtttctctctgccctccaatccactttgccttctaaatgaaggtgatttaacttgtaaggtcattttaagaagaagctatgtgtgtttctggcaaaagtttctatacctctccttgcagaagttgactgatacctgcttctagaatttttgctgcattctggccacaggcatttcttttaattaacaggcgcttaagtggagagctagagtctcttgatcataataaatggagtgttgcttcagatggcaggaataagcataattggatgaaaaccctacacacagagagccaggacactggctgattcagggaaccaactgaaggctgaccctcatgggaaggtgactagatttagctttggttcattggttctgaaatattgccacagctgccttaactcttctccacttcagggggactgcttacatttagcaaatcacttctttgtaacaatgcaattaggtgctctttgggaggttttgtgtgcattggagtgaggtgtggtggctcacgcctgtaataccagcactttgggaggctgaggcaggtggatcacctgaggtcaggagttcgagaccagtctggctaacatgatgaaaccctgtctgtactaaaaatacaaaacttagcagagtgtggtggtacatgcctgtaatcccagctactcgggaggctgaggcaggagaatcacttgaacttgggagggggaggttgcagtgagctgagatcatgccactgcactctagtgtgggcaacagagcgagactttgtcaaaaaaaaaaaaaaatcaactttctgatacttcttcaccctgagagtctcatttaggagaactggagtggaacccaggaatctttacttttatcaggtgtctaggagattctgatgtaggtaatccatggacctccctttaagaaacatgatatagtggctttttacaacagtgttcattctaaaactggacatattgtcatatctagtactgtattttcccttcagaaaagcatataggcagaatagtgactattaacccatgata

SEQ ID NO: 7921 - DNA, 1239 bp, mus musculus
aggcagccttccatcccaggaaccctgctgggtggccagtcctttcctgccccgcctgggcccccacagaaaacattaacactcggccagaacgaacagtcttctcacttccccccacctcttcctgccccaatgaaaatagctcagcaaggcccaatttccttttcctgtctattgtaacatataggcaaactttaaaaccaagtaattaaaatacaaaagtggatcccagggtaagttcgcaaaacaaggaacatctttcatgtccctccctgtccgggagccacagtggcagtgactgtacctagcccagggggcaggagcaggctctgcacctgtcagcacctgcttctctccgttctcacacacgagtgctgtggctcgcaccgtcatcggagtctcaggtgacacgcatcctgctccttccgtgccggctcctgggctgccctgctggagacaccatctggatttggccaaaggtctggctcctgtaatgttcattttctcttccccaggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcc

SEQ ID NO: 7922 - DNA, 1239 bp, mus musculus
ggcatgtgaggcccagaagactggctctgccaccagaaggaaggattgtttccttcaaccaaccttttggttgctaccatttcttgtccttgagaaaggtgctcctagtgcttgtagagggaaacgctacgtccgtgcagtatggctctccctttccacaggagcgatcctccagccctaccccaaactgcaggtttccaattggttatgatgtgccagagaccaggaaatgccagagggatgtttgtaacaaagctgccaaactctaagccttcttgttctaccccctaaggagaaaaaagatgtgtaagaaattagcccatggaccccagctccacctgaacatcaatataccgtgaggacattccagagtccctgcaaaaggtctcgtgagctgcagttcattgagtggctttaggtcacacggagaaaggagggttccagttccctctgagaggtgagggattgtggttacaggttgtaacagctgtcacaggagggtaaaaagtctccagcatcttgctgaggatgcccagtaggcagcagctgagtgaggatggatggaatgcagggcaggaggggagcccaagtgcagaggctggggctcagacagccaaagggccccacacacagggcctcgtctcagagtcctccaggctgctggatgacaagcgccggcgctgggcattccgactgacggcattgtcatcagcctgccaggcacctggggaagagaaaatgaacattacaggagccagacctttggccaaatccagatggtgtctccagcagggcagcccaggagccggcacggaaggagcaggatgcgtgtcacctgagactccgatgacggtgcgagccacagcactcgtgtgtgagaacggagagaagcaggtgctgacaggtgcagagcctgctcctgccccctgggctaggtacagtcactgccactgtggctcccggacagggagggacatgaaagatgttccttgttttgcgaacttaccctgggatccacttttgtattttaattacttggttttaaagtttgcctatatgttacaatagacaggaaaaggaaattgggccttgctgagctattttcattggggcaggaagaggtggggggaagtgagaagactgttcgttctggccgagtgttaatgttttctgtgggggcccaggcggggcaggaaaggactggccacccagcagggttcctgggatggaaggctgcct

SEQ ID NO: 7923 - DNA, 1000 bp, mus musculus
ctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaaagtgttgttgggtccacaccgtgtttagacatcaggtgtgccaggctctgggggacaggtcatgaggcagagtccctgtccttgtgaagctacaggctaacggggaagacagggaacaggaagcacacctcccagcccggagcaatgacacagtgggacacgagcagga

SEQ ID NO: 7924 - DNA, 624 bp, mus musculus
tgcttgctatgtttcatgaagttaaggtgcatggaggtcggaaagagaaaaggcaaacacccagtcataaggacactgaataccaacatgaaaaaaaaaataaagaaacatcaatgacctaggccgggcatgggagctcacgcctgtaattccagcactttgagaggccaaggcaggagtattgcttgagccctggagttcgagatcagcctgggcaacagagccagaccccctgtctacaaataatacaaaaattaaccaggcatggtggcgtgcacctgtagtccttgctgctcaggaggctgaggtgggaggatcacttgagcccaagagtttgaggctgtagtgagctttgatcaccactgcactccaccctgagcaacagagtgagaccctatctcaaaaaaaaaaaatgacccaaattacgaagtgcaggagatagtcaaacctggcagagccaccaagaggcccctgcagagccagccctccctggagccccatcctatggtcctgccttagtcggggtggagaggtgggtgattttctcttctcttccaaggagtgtctgctaaattgttcaaatgtgattggcctgtctgggtgcagagattaggagccagcggg

SEQ ID NO: 7925 - DNA, 897 bp, mus musculus
cagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctt

SEQ ID NO: 7926 - DNA, 1793 bp, mus musculus
ggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacgggtcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggccgacgcccgtgctcctcccgtcctttccccagtcattttctgcccggcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaa

SEQ ID NO: 7927 - DNA, 3629 bp, mus musculus
cggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcagggtgagtgcggaggccggccgcgccggagagtgggagggggccagccggggctggggccggggccgctcgcggcggagacccgggccggcgggtggataaggctggtggagcggccgcccggaggtccggagggtgcgtgtgggcgcggagggggtggtgggcgggagcgaggtcgttctttcggggtccggtcccggaggctgagacccttcccagctctttgtttgttccggacgttggggcctcgtggcaggagaggaggggacgctgggcgcggcacaggcggcgggaagttagtctaagggaactgaagttgtgcggccgcggtgggaccgtgcggcctcgggctggggcagctgcagcgccggagggagcgctggcggccccgtttcggccggatcctctcaggccgggaagaggaagggtccggagtagccgtgagggtcaggaaagccctggactgagactcacagatctgctcttgttgcggtttttttttcagccaaaacaacttcccgacaagtggcagcacgatcttttcgacagtggcttcggcggtggtgccggcgtggagacaggtgggaaactgctggtgtccaatctggattttggagtctcagacgccgatattcaggtaagagacgagggcttctcggtgagccgttcgccctgcacaggacggatcgtgattttggggatgtggccctgagtccccttcccgccttagcgaagggagccctcccagctctgaagggctgcaggacagacccagtgctagtaaagccggggtcagtgcgcaggcaggtgcgagcctagctgagcctgaggaactgctgctgttagtctgaagatgggttctgtgagtgaaaatcccctgccagggcttccagtttctaacagggacaaagactgaccaaatgtgagtggtttttggctgttagacccagcccagttgctttttaaattttgtgcctgtcttagtgggttaatgtgagaaaaagaatcttctttatgtatcttgtgaagcacagggagtctgtttttctggctctgtttgccttgagtactgtcttataaagaccttgtacgctgtggttttatcactccccaccgccgtgtcccgtcagtgacatgactctcaaatccatctttggttgaagcttttcttttttaaaaaaagaaaaattgaatcccaatggcatttcaacttgttttctggttaagaaatgactttttgggaatcagttttggagatggctgggcagggttcagttgcccacagcccagccatttgccttgggaggacagagtagggccagtgagcactcacagtgtctcaacactttttttaaggtggtttctagcatccactggaaaccgcttttggtgaactccagttcccgctgtgtgcctgcggccggagtatccccacactctgggttccctctccaactcccagcctgcctgaggtcagggcagtttccatgacagcgcttgacttcagactttgccgcaggcttgagtaggaggagagggaaaggtgagccagaatctgcctttgggggaggggctggggtcagggctcccgaatctacaggcccttcaagctggtctgatatcggactgcttcccttgctcttgattttggcctttaccgtttcttggaacagcccttgggtgtgttgtacattttcctttgttgaagaggatagtggcttaattttgtgcccgttgctagtgggctttgcagcttcctctacctgcatcgtggtacacgtgtcaggtccccacaatggcaggagccctcagacccaggtgctcttggaagttgctgtccctcctgccccgcccttccctcatttcccgttaaccactgtcctgcctcccagagaaccacccccaaagcaactcacgcttccagggcctgtccctgggccaccagaaggaacgcagttttgttgcttttctgacaactgctctctgcaactcccaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggtgagtctgggggtggacccacgctgactgtggggcttgtggagtttggggctggcacctgtccaggtaggaatatggggtacccctgtggctgaggacactttgcatttgcccctttgtctctctcttccatctgccacctctcatgctgccccacacatctggaccaacctcttgtgaacccccatccagcaagctacatccctcccctccttcagctccttccggaagattcacttctgtgaagccttctcagaaccgccatagtacacctctgagtgcggggctgtagtcgtaaagacaaaggtaccggttcttcttcgtcaggtcacccacacctctccacccacgagcaccccgatacctcagcgagcagcccacctagtctggactgagaaggagtgaggaggtgttggtggggttgcttccttgccattttgttctcccaccagtatctccaggccatttcccttgtcgggggcatttgagacgcacagaggccctttccagtgtttgcatggagaccagggtgtggcgccagctgggtgggtttcagagcctctcaatagaacgtgccttctcgtattctttgccgcaggccgccccatgaacattcagcttgtcacgtcacagattgacgcacagcggaggcctgcacagaggtgacttccggggcctctggggaaggggattggccgagggtgaggctgcgtcgctcttagggtccttccgggtgtgtgaacggtttcgtcttccttgctagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagagtgagtcccgggggagccagctgggggcctggtcaaagccgcagtggggagcaggccgcctgtgaatgcaagcctctttctcctctgtgtttcagatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaactgga

SEQ ID NO: 7928 - DNA, 493 bp, mus musculus
gtgtaaagcacagcgcttctccggagagactttgatctgaaaaggccaaaaagaacagtgagaagacctggagccagaggaagtctaaaatcactaaagtttttcaattaaatttcagttttaatttagttcatagccttagggttgtcaggttaggtagctgatgtcctaatatggacggctccaagggatgactgggagaaaatggcgaccacagtaaatgccgctagggaaaaaatgagtcttcagaaatatttttctttcctattaatccatttcactactgaaattcaagaatgttcaatttttatcattaaaaagatagccatattcacttgtgccttattaattgcatttgttcacttccccccaaattggctgtaaaacaaatttcaggttatgaaattattttcaccacgattggcacattgggagggcaatattatctctgggaaattgtttggcctcaatattcaatgcaaaacaaagcaaa

SEQ ID NO: 7929 - DNA, 742 bp, mus musculus
accattatctgcttgacttagcctcttagcagaaaagcttagaaatgaaatattagaagacaatcaattttccactggaaatggaattgaaggatctctaaaattaaaataaatatattggaaaagattatgtgatggacacaaaatttactgctttttagtgtaataaatgtcatatagggcaagatatgtttgcacttgatttaatagaggggttgctgtttgatttggctgatttaatttctacctataattctaaacataaacataaatgctcatgaaatgcaatattagcaccttatattactttctagcagttcttagagtatgctgagacttcagattcttttgatttaaagtgaattgggcctggtgcggtggcttacgtctgaaatcccagcactttgggaggctgaggcgggcagatcacctgaggtcaggagtttgagaccagcctggccaacatggcaaaatcctgtctctactaaaaaaatacaaaaatagctgggcgtggtggtgcacgcctgcaatcccacctacttaggaggctgaagcatgagaattgcttgaaccctggaggcggaggttgcagtgagccaagattgcaccactgcactctagcctgggcaacacagcgagagtctgtcccaaaaaaaaaaaaaaaaaaaagtaaaaagaataacctatttttttattgtcagtaatctaaaaacaggaagtgatggaagtatctgtatttctc

SEQ ID NO: 7930 - DNA, 280 bp, mus musculus
cttcagtcctagcaatcagtcttttgttgtatgacgaagctcgcagtttatattgcagttctggtaaaaagatcagtgtcttactcctcaatgtttgatgctgtcatttggccgcttgaatatattccagtgcttccaaaaataggccctaaaatattggcacaagttcttccggggctaattctattccgaattttagcagttttggtgtgtagattctattgctattcctttctgatgctgagtccccttctacttggttttactgctgcctatgctt

SEQ ID NO: 7931 - DNA, 199 bp, mus musculus
tgggccgtggaaccttgggcccctgacctttcaggctgggttgtctcttgtggccctaatgtttgcagcaaaccggtggcttggttgtaaatttcatctttctatgggcttcagtcattcagagggcaagcacggacttctaaggattagagggagcctccttgttcaaatgtttatgtgatttcctcttccagccaca

SEQ ID NO: 7932 - DNA, 1011 bp, mus musculus
agctatttaattaggttcttaagacatttagaacaccaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaataagccactagccagctgcttcaggaaaaccaccctcttgcccctgtggcgtccagtgaggatgatcagaatggtcccgggggtaatgctggctcgcagttttctcacgtgctgactgaagggttttttgccgtggctcaacagctttcgaggcacatcttcagtaggatactatctaggcattttgcgaagtttaaccacccgggtaccgccgttcttgtcaccaccaactggttttgtaacagctgcaagaaccttctccttctttttcttttcaaccttggatttagcggctgagtacttcctcttctacatggcctttctggaatacatggcagatcgggaatacctgccaattcctctgacaaggacagggttgcggctgcaatggggcttccccttcttgggctttttagctttgaggttaccctttttcaccttgccaccagcatcaaccttcttggcttcgggtttcttctctttagtatctggcttctcaactttttcacctgccatcttgcaagatgggaaagagcagtgtcttttttagactcttttctgtgtgacatatatgtttacaattgttatatcttcttgatgaaaggaccctttaccaatattagtgttcttctc

SEQ ID NO: 7933 - DNA, 1921 bp, mus musculus
acagttctaatatagacaaaaagttatgcacagacatacatttaccttgttattaaaaacactccccaaagcctgggcaacatagtaaaacctcatcgctacaaaaaaaaatctttttttaattggttgggcatggtggtgtgcacctgtaatcctatctactcaggaggctgaggcaggctgatccctcgagccgaggagttcgaggctccagtgagctatgatcgcagcacagcactccagcctgggcaacagagcaagacttcttctcctaacaacaacaaaaaacctcccaaaagagaagcaaatatgtaagctaggattgcttcttagtccttgctattatacataacagcagtgcaagtctttgtgcaaaaatttatctagttttttttttttttttttttttttgagacagagtctcactttgtcactcaggctggagggtagtggcgtgatctcggctcactgcaacctccgcctcccgggttcaagcaattctcctgcctcagactcccgagtagctgggatttcaggcgtgtgccaccatgcctggctcatgtttgtatttttagtagagatggggtttcaccatgttggccaggctggtctcgaactcctgacctcaggtgatccacccacctcgacctcccaaagtgctgggattacagatgtgaaccactgcacctagcctagatttagaattattactttaggatgcagtcccagaagtaaaatgattgcatcgaagggtatccatgtattcacaggcctctatcaccatcctgctttccacaggaggtacccacaagcacttccacaaaaaatatctgagaatacttaccttacctatatctgtcgcatgaaatgcatgatgttaagaaaggattcagaattaacccctcccgccatggaccagatcatcatcaccctgtcttcagtgaatgaaccctctgccagggtatggtggtggagcaggtgtcctgagcttgaacatgacacctttcatgataagtacttatggcccccaaaacaaataagcatgtggacattgtttctggctttctgtttgtactctgtccctcttcttaggtcaaccaggcaccgcccaagcttcccaagctgtgcttagctccccttttctgtcatccaggccctgccaggggttaacacagcagtccttgctgtgttgctctcgtgcctgctggaatgacttttttctctctttctttcctccaggtgtccaacgtcctcctattcttctgctcgtggtttgcaagacactgtgtaacctcagattataaggttcccacatatattccccttttacccactgcagagcctaatacttttcttttcttttttcttttttcttttcttttcttttttttttttttttttttttttgagacagggtctcattctcacctaggctgaagtgcagtggcacaatcatggctcactcgaggtcactatcctggacatcccaggctcaggtgatccttccacctcagcctcccaagtagttgggactataggcatgcactaccacacccagctattagtaatttttgtattttttgtagagatggggtttcaccatgttggcgaggctggtctcaaactcctggcctcaagtgatctgcccgtcttggcctcccaaagtactgggattacaggcgtgagccatggcacccggccctgattcatttctttggtttaaagtgtaaatggtgtttcttgtcaccttttaaaatgtgagtgctcttgggaaaggaaattcattaaactgcttcagaccataattatcttaatatgaggtaatctgtcaggcccgtcccttctcccccttttttctcctctcccccattgcctcctttttctttcttcctttcctccctttcatgcagttttatgtata

SEQ ID NO: 7934 - DNA, 175 bp, mus musculus
ggtaatgaattcttaagtgtggcctaagcacaacaatgttagccccagacacaaggagcgggcatccgtactcacacgcgagctcttttccaaggcctccgtggggggctcctgagaagactgggaggcaggacggaagagcagagaagccccgtcccccaccacgagcctaaca

SEQ ID NO: 7935 - DNA, 1099 bp, mus musculus
cattttagccagtgggtacatgtcctgtcaaatcatttctgagagctactgaagaagagaacaaaatggccatcatgagttttgtttcatctccctgctcttgccacgacctcttctgagaatgatgtaatgcgatgactcggacaaagggtgagccgttggaggggaaaataagaaagggaaagagactggaatccctagagtacagccgctcattcctaagcattggctacaaaattacatttggagagtattgaaatgccatcaaacctttaggtaatacgagtcaagaattaataacgtaagcattttgctcagtcccacaatcataaggtactaggtaacaactaactttgtttcaaaaagccctctaaggtactgagacacacctgtcattaggaatcaaattcccctggggacacacatcgatgaccatcaagccgctcatcaagtgcgcaatgagaagcactgtgtcttccgtttatagcatcgtctctttcctccaggagcttggcagcgacactgatgagcaatgagattacttgaagggatcaaaggcgagtctgtgttccactctacagcacagaaatgctgcaaaattatggtaaattatgtcagtacgtcttcgtgctgttccaagctctcatctgtaaaatgttaacagtaatctgtgaaatgcaaaccacatattttcttgtgttcttacagcatagagaggattcatgagctcatggccaccaaaaagcccactgttattgtggagctacttgggggggacccaccatcccagccagtcataaccaggcctgtggctctctggaagctcccactgctaccctctgccattgctgctgaagaccaggtaacccactacctggacatcatgctctctcacacacctcttacatgacacacacacacacctcacacctgacaacatacacctcacaccacacacatgatcacacacacttcacaccacacacatgctcacacacacttcacacttcacaccactcacctcacactacacatatacacacctcacacatctcacaccacacacatgctcacacacttcacacctcatatatggtta

SEQ ID NO: 7936 - DNA, 313 bp, mus musculus
cggttgcaaaataaaaatgaaatagctagaataggaggcaagcataataggagatgctatcaggtgcctgcaataggtcaagtgtctcccgtgcccagaagccagcctaaagcacaatgagttagcataattctatttttctgacaaaaaaaaaaaaaaacaatatgtgccaacaatacatctgtagaacatgtctttggctataagttggctgaaccaagaatgcctcactcagtgctgtatacagaagatatggtcactttggtagcttggtaccttggaaaaaaaatattgattaatgtgacgcctgagg

SEQ ID NO: 7937 - DNA, 1654 bp, mus musculus
ttgtatttttatcatgctttcattttttacttgttttctaaaaagttactttttccttttattgttcctccatttgaagtcttagtgatataactgaaactaagactcttgcatggttttaatgtatttcagattttcattcactagcttctgcctgccttagagtctgacatgtagccactaagggtcttcattaatccgttcccttttttgtcctctctgtatattcctaacagctgaattattttctttttattgtttgttttctttttttcagcaatgcggccacttagcatgtcttacagttttgacttgtcaggtaaaaaaaacaaaaacacttttacacctgacgtgggttttgtggtttctgtgaaatacatttcattcatctgcttgttcaaacatgttaaaaaagaaaattgaaaggcttctgctaagccgtggtcagtaaaataaaacattctgcttgtttgaaaacaatatatgtaaaaaagatacaagactacagtaaatctgttttctcctaagcaattttggaagaaccatcacaccacactcatggttctagaagatggtgcccatcttaatggcggctgtcactgtccaggctcttctagagcaatgaggttaaagcctacagcagacctttgccctaagagaatagaaaaaaacttcatagaaacaaaattctgacacatctacttcctgttctctaaagcattcagttatttaagtaactaaacttaaaatggttatctacttcagatgacagcacctcagttgatgggcaagaactcttttgtatctttgtgctcagtggatagagcctagtcatgaatgactttgaatgctgattaagagtataaaaatacaggccgggcgcggtggctcacgcctgtaatcccagcactttgggaagctgaggtgggcggatcttaaggtcaggagatggagaccatcctggctaacacggtgaaaccccgtctctactaaaaatacaaaaaaattagccaggcgtggtggcacacacctgtagtcccagctgcttgggaggctgaggcaggagaattgcttgaagccaggaggcggaggttgcagtgagccgagatcgcgccactgaacatcagcctgggcaacagagcgagactcagtctcaaaaaaaaaaaaaaaagagtataaaaatacaagagcattgtaatggctttggttgtaatatataattatgtgcctcagatttgtagtacaagtttagacccttctgttaaacagagattaatagtgaaataactaaatttgagctataaaatcaaccctttataaattaaaactttaaatatatatgagtgaattttcttttatttatttatttatttattttaggaaatagagacagggtttcaccatgttgcccaggctgctctcaaactcctgggctcaagcaattcaccaaccttggcctcccaaagtgctaggaatacaggcgtaagccacctcacccagccaggtgaattttcaaagccaacttaatcccaataaaatattttgcaagttagagtttttaattttggaagctactgttttaaatataaaatgagatgagatgttggcacaaatattttcttttgggattttcttttaaatgccatagaatgcc

SEQ ID NO: 7938 - DNA, 1654 bp, mus musculus; identical to SEQ ID NO: 7937

SEQ ID NO: 7939 - DNA, 488 bp, mus musculus
aaaagtctttattaacaaactgcatatattttcaaagtataatacaataattggagaataaaatgtaaattatttacttatatagttaacatttgcagagctttatcttgagaaatgtactttgatgatgtttcaatttgaggaagagattagtgtctcaagtatagcatttctttcactgccaatgagagcgaatcaaactttctgagaaactttcacatttcttgctgtgttccgggatctccagtcttctttaaatttggagaaattgcccatgaaggagccgactgctgtgtccagcatgtgatgggggaggaactccagcccaggaaggggctcccctggaccctcagatggagtcgaagtgagtgaatgcacctggcagcttgggaggcctgagtggaggggaggggcagcactctttaagacccaggcccactcctggggaagggaccagcagggcttgcttggctcttggcctcctggga

SEQ ID NO: 7940 - DNA, 214 bp, mus musculus
cttcccaactaatttcctccactgtgcaggtgcttgtccccagaacttctaatggtgtaggagaattggaagctttactgattctttcccttctctagacagacaaagctcctagctccccagcatagcctcaagccacagaaaacttacccctaagagctctcatgtaccaccttcaaaaaagaatggatcctttcctgtttagctttcccca

SEQ ID NO: 7941 - DNA, 1035 bp, mus musculus
tccaaaagtaaaacaaagaaaaacatgtttaccatgattgaccaggaaattgcacctgcattctatttcacctatggataggtcttccaaggaccaaattctaagatagaaatctctgaatattctaaggtcataatgactttcctggccccaaacctaatgtcacatttcttctgacaggctacagaaacaagagaaaacaaaaaaaaaaaaaggtccacaggatggcttgggttgaattatgtgtgtttatgaaggaaagtgtcaactagaccacatgtgtcaaggggaaaaatatcataaagaatttcccaaagaaatccttgagccaaaaccctttcttaagtaaaaatatcatcatttcagggcacattcctctcctgtcatgcatgcatgagcagactgcttcctgctgaaagctcattctgaaaatgaaatgcagtccctatggtaagcctagctttccataaaggcaggacagagtaaacaaaataatcctcactttcagttccatttctttactttaggtaggatctagaatgttcagggaacaggaattcttcgggaaattctagctctttgaaatatagccacacagtcaaacttggcaaaaggttttaaaattgtattcttaaaaaaactatatgaagaagcttttataactcagtatattttttaaaaaccaattgtttctttataagtttcccaacccaacataccatgcaaatcattatttttaccttatgattcaaatgtatccttgaccacatgtaatgggtaaagccacagagacatgatccctctcctacaactcagaagctaactgatttggtgtttaatttttactttacatgatatttcttttgttcttatcattctcaggaagagtcctatagcctgatatgcaatgtacactttggtggtttttggatgcaaccaaaaaaattgtaaattttgtaccatttttgacatatagaaaccacagtttcacatgattcagctcaggaaaggactcatctctctagacctgtttct

SEQ ID NO: 7942 - DNA, 457 bp, mus musculus
actttacaaatggggaaaccaaaggtcacagtcaaataacttgcctgtcgtcttacagctggtaggtaataggactgtcactcagacccatattttttctgaaaagcctcttttctttccattatccaacactgtctcaaaagaagaatatttttctagatatgatctgactaatgcagagcagagcagagatatgactaacttttagttcccatttatataaagcttatatactatttttgaaaacttaggattcaggataatcctaatggcgttatagcgttcctaaagatcctgttgcgtttaagtagacatctacaaaaacttcagtaaaactatgtagatgtaacattattttggcttagaatagttatttttgtatgaacacatctcacaagtagaattatcattcttactggtatacttttaggataatggatatccaatagaattctga

SEQ ID NO: 7943 - DNA, 457 bp, mus musculus; identical to SEQ ID NO: 7942

SEQ ID NO: 7944 - DNA, 1037 bp, mus musculus
aagttattctagatataaaacccttaagaatcttctccaaaagacaatttaatactgagttacaactatgattatttttaaaattgtttccatttttaaattcctttctttggtttatcctcctactttttttttttttttttttttttttgagtcgggattttactcctgtcgcccaggctggagagcgatagcatgatcttggctcactgcaacctctgcctcccaggttcaagtgattcttctgcctcagcctcccaagtagctgggtctacaggcacaaaccactgcacccggctaatttttgtattttttgtagagacggggtttcaccatgttgaccaggctggtctattttgttgttgtttgtttgtttttgagacagagtcttgctcagtcgcctaggctggagtgcagtggcgcgatctcagctcactgcaagctccgcctgctgggttcacgccattctcctgcctcagcctcccaagtagctgggactacaggcgcccgccaccacgcccggctaatttctttttttttgaatttttagtagagacggggtttcaccatattagccaggatggtctcgatctcctgacctcgtgatccactcgcctaggcctcccaaagtgctaggattacaggcgtgagccaccgtgccccgcccaggctcgtcttgaactcctgagctcaagtgatccacctgccttggcctcccaaaattctgggattgggattataggcgtaagccactgcccctggacaacacttttgatgtatttaatttatatagtaactttgtgaaaagaggttgcatataatgattttctaaagaatatgtaacatattgtcaaaatatattcttaattccctttacagtttacataaactattatgctaacttttctatactactgaaataatttatcataataacatcatatttaatgaaaccacctgtagtaaaatatataggctaattcctcctgaaatataacccttagcatagatcctgtaacatagtaagccttcagtaa

SEQ ID NO: 7945 - DNA, 231 bp, mus musculus
gttgctcttcatattttcttcttttctaaactatttataatttcactgcaataggtgtaggtcttacttgatatttattgattctattggaactcacggttttttaatatttaggactttcaacatttctgggagattctcagcaattttctcattaaataataattatttctatttatttctttttattcttcctgggccacatatttaacccatgtgttaacttctcat

SEQ ID NO: 7946 - DNA, 135 bp, mus musculus
agtagttacatttgttgttttacactattgtttttgttatagattattaatagccagtggaaaacattaagttttctgtggatatgtaaaacgtgaaggtatacaattctcgaattatatatcatagttttaaat

SEQ ID NO: 7947 - DNA, 324 bp, mus musculus
gacttatagaaaatactaattcagcattattataacaaccaataatagaattatctcatatccaatgatagaattatataaattactagtatattgatatttctgaatctttatgtattagaaagtttacttatagagattacataattagaataattacaattcttaataatgtgtgcttgcttaggcaagagagcaaaaacagacttccaaattatacataaaattgtataaattctgtatatacacatcatgatatcaatgatttaaaaatatgtatggaaaatggaataaatactatgcttatcagttattttagactat

SEQ ID NO: 7948 - DNA, 758 bp, mus musculus
ttggtaaaaattccaaaataaattgtgaaatacagagacatagatgattaaaatggtagggaagaggacacattacttgactgttttgagagtgaaattttccgggaaaaggcactcatcttttctgtgattttattttctgaccttgtagactatttctgatttttacattactacaaaataaaaccaggatttatgtttattatttacatagctgctttatgtagttttgatagttatctttttgttgttgttgttagcctatgggaaggaagagtttggaaggcccggaggaattcttgtgggtgctaagtgactcttctgtttatatatgttctcattctatgattttgcttgaaaacctaatgtcttggaacttacatataaattttaataacatagttagacaagagcttaatagtatttacacagcagtctgcttcattttttaaatctaaaattataatgcaattcagcagaaaaaaatgtctatttgaagtcaggaataaattccttgactactcagtgtaacaaatgttaaaaaaaaaagtcacatttgtccttaagtccttcaactttatcctgtgagatttttatttaaatcatcagtaatcttcatcacatttacttttccaacttttatattgttaaagaggttaggtaggcttttatctcttcgttttaaatgaatcttgaaaaatgcaaccataaatagctttgtaaagttcatatagttttagaacacctattagaaacta

SEQ ID NO: 7949 - DNA, 1029 bp, mus musculus
tcaacccaagaaaacaccacacaattagcataggctggattattacatttgttatgttcaacgaagtgatatcatagtctttgtgttttttatgatgatcagacccacttttgaattcattctgtattcagtactacatactatattctatagactgagttggctgaaatccaggacataataagtaggtaggggaacttgggcaagatttgctaggcagggcatgctgtgactttaactatttgaataattcacgtgtatagaagacatggagttattctgggtgaaggtgcagatgccaaaaccaaggccattgcgtagaaagtgtctagagtgagatgggggcccagtcaccgtccagagaggaaagcaggccacagttcttccattgctcagacgtgcctggagtggtgagcagagactgagtgaacacctgctgtggaggtgggcactgcagtggcaaaaatggggactcagtggcacctttcaatggcagacccaggctcttggccaagttgtgatgaaagaaattcagcagcaggtgggcgaatcagaggtgacaaaaccctgtttggggctgtttatcaccattttgagaaaattaaaaccaaagcaatgttttctgagactatttttgaacccattatgagtatgatttctagagtaggaagtacaggattggaggatgatgtgctcattaaagtccccaagaatggacagcagtgatgattcagaacaggcaagtcctggaagaggcctggttccgatgtggcaataggggagtagcttgaggaaacacactgcacatcccttgaagccttggactcaacaaagagaggccctgaagaattaagtgggctctctgctgcctctggcttcatgtcgcctgtatttaaatcatgatccctttcatcatgttgttccaacaagcatattttccagagatcaaagcagattcctcgatgacacacataagaaatgcaggcgtggggtggaggtgacatgagatattagacaggtttgtagggc

SEQ ID NO: 7950 - DNA, 983 bp, mus musculus
agtattcatttttctttctctctttaagccccagatgcagtgaagagaagcaaaagagagcagcactaaaggaaaatataagtgacccaccatttatggagtatctcctgtgtgcaaggcattttagacaatttaatgttttaaacttgatacctagaccctaacccctaccctgatactgaatatctatatgaccttgtgacttagttctccctgagcttgcatattctcccttgaaaaccaagagggctgccctagagtatcccaggaatcttttcttgcacaatcattcaggaacaagtgccagccatatctcattttaagtatctaacatcctttggatactcctgttatcttgtttctccaagctgggggagtggtcccattgctctgtagcagttttgctatgtgttcttgaatttaaccacggttagaaatgcttgaaatagttctttatctttcttcctgaaactgctgagatggacagtcaggaggaagaacatataccatcccagatattgagcacagtgtgggggtgggtggtcagagctggggccagcacagtggcagcagctctcattcattcccatggcttgccctggctgtgtgggcaaaggtctctccagcaatccagcagcctgtttccatattatcagtgctttctcctctctggctttattaaacatgttaagtaagatgttttgccatgttcttacagagtctgttgcattgattattcacaatgccatcacccctcctcccaccctgcttagtactcccccactcccaggcttgatttattacccactatattgttccaagcacagacctttttatcactgtcacatatgtgggcctggtgatgagatatgcttggtagtggctggaggggcaggatggagctgtaggaaccaagcaagaaggaagtttgcaactgattttatcttgttctaaaactcatttctgcttatattttggaaaat

SEQ ID NO: 7951 - DNA, 1032 bp, mus musculus
cttcctttagagttcaactctaaatttgtattttattcataattatttcatagcatttttcaggtcattttattactgtgtgttccttagattctaacaccctatgttgttgtactgactgcgtcattgattctgtttcttgatgtgaattgcatttgttccctgtgactaatttcctgtaattgcagccagagagggttctgttttcatcagctcagtccaaggtgatcagtattttcttaacataatgtttaccttgaatatattatgattttaattgtgaaatgctattcaattttttaaggattccctcagaagtaatgtgctctgtaaagtttaggagacacaatattttatagattttgctagtaaaaccagaattagaaacttgtactttttgacattgacacatgccattattgctatataggaaatctccataacatcaacatcaatttcaagtaaaaaatagggcactatttatctcaaaaccaagttagccccaagtcatgatcacattattgtcatttactctttgtaaatactgttacatgtgacacctgtctttgccaataaaatccataatcctggagagcagataatgtattttcaattttctttggcctcacccacgttatttgggacaaagcccaaaaatatatgggtatttagtccttatggaggcacagaatgatgtagaaatgagagagggagaatgccagcatgagtggttgccaggttcattggcaagcatcttggcaacgtcttacctgaagaggcagcatgacgtggtggaaagaggtggattttgaatcagacgaacttcggttttcatcccagctctgctgtgcactaactgtgtaaccttgggcaagtacttaaagtttctcaatcttgttttttcttttttttccacctgagaaatgtagttaataatacctaactcacaggtgttttgtgagtatcaaatgaatataaatcatcttgcaacatcttgacaaaattagtaattgcaaaaaaaaaaaaacaaaa

SEQ ID NO: 7952 - DNA, 1196 bp, mus musculus
ataaatagcagaaataatttagttttaatttagtttcatggctaatttgaagcagtactaaataaaactcataacataatattccttgagtttgaattttgctttcttttttcaaaagcactgtcttatgtgctacttttgttgatccttatagaactcccatgcgttgactagtgttactattatcgccatcttacaaataaggtttcatggccaaccaataacagatatttagtgatagatttgaggctttaatataggtctttagtgatttcttcttatgcaattctgctgaagagggacagtggagaagatatatcctgagaagcaatgatctcaaattaaacattagtactttgagataaattttaaggtagtggatgcctccaagaatgcagtcctagtgtgcttttctgcgcaaatgatacagcaggcagctgctaccatttctgcctgataaagctttgtatacatttggcctcatgcttgagaagataaatgagttcacttcaggattgggtctataggcagatgattgaaattcagggaagtgtttatatgcattcaagagagtatttctgacagtgtatttctgcatgggtggtctcaaagggagtgaatgaatggaaacagaaagattgtttatggggaggaaatgaaaaggattagtttctatggaggccaggcaggtgacctagattccccacaatgaaatgtgtactctgatagacactttttaaaagagagaaaaaaaaaaagccgtggataaaaggtctggctttagtttctagccaattctcatcaagtccctttgaagggattttctgatcccaagagaagcttttatttgatatacgtttcatgtgctgggcttatctagagctcagataatcacacagaggagttctcacctagattactcagcgtgcccctggcctcagcaggctcttctttggggctttgagtttaaataaacaaacacgaaatctgaaagattcacttataatccttgggtcacagagcccttttcagagtaactattcttatttccctgtgaaattgaaaaacaaccccatgcatcttcaaataaattgcaagtgattccacaagatttctcttttgggagaggaatatcagtgaatgtacaaagagcagtggaatagaaaatagaaaaattgtatggttggccatatgct

SEQ ID NO: 7953 - DNA, 262 bp, mus musculus
atcacttctgcctcattctacttgtcagtgcaagtcagaagcccagtgcaaattctaggagtgagcaaacaactgtcccttctttatgaagaggaacaaactcatgtggcaaatgacatgaatactggaaaggaagaagaatcagggtcattgacacaatcaatcagccacaggtctcaacaccaatcactctttgcttaaatctacccactgatttatagtgtcttcactataaatcaccaactctactctcctcagatac

SEQ ID NO: 7954 - DNA, 1608 bp, mus musculus
tctgtatgttgacccagactcttgggaattttacctggatattttcagattcttaaacataatttttaatgtcatttgaatggatgcagaggagagctgtataagtaattgagtatgaactttaaaaatacattaggattcaaaactgcatgctacaaaatcaccatctttttaaccttttcaaaaaggtgtaacatatgtacagaaaagtgctcaaatcataacatacagctctccataaattatcacagagtgaagacacccatgtcattaccactaagaaaaaaagagagaaaccatcacaccccagaacccaccctgtgctcctcccagcctcatgtgcccatccggaatgttttccttttctctgcttttctcctcaagtctgtcttagccccctcttctcttctggccacctcacttcccaggcctccccgataccccgggcagtggggggcttttttgaggctggtttgccttttggcacagtggaaatagcatgtgctctggagccagctctccaagatctagatctcagcccacctactcactagctttgtgaatccaagcaagagacctaatccctctcagctccccaggcactatcctggggtcacaggtgctgattgggtacttcccagagtggctaccgagtgcctgctgctcagcatggggctcaaatacacccactgcattttcatttctatgcttttgcttgggtctctgaaagctcccgagggatgttcattgtttccatttcacagattgccacaatgatgcctgcagaggtgaaatgacttgcccagcatcacacagtggggcaagggcagagtgaagcctggaccctaggctctgaggccacagcagcacaggacccggagctgtgccctccggccccagacctgccatggtcctgtggctgtttagacgactgtttggcccaggggtgcctggctctctaaaagattcactgttgccctcaccaatatttatttcagccttcccagaatgtttcctaaacagacacacgaatgccaactttatgacacttgctaataaaaataaaccccctcagtaggactgggttcccgtggtgcctaataatagctacaggcgtgaatgagtaaatagctggccacacaaagtgtgtgggaccctccagggccagacagaatgtgtagcagttagtgccaaaggcagcgtctgcacccagggcctggggccagtgatgggacacctggcaggacaaggagagcaggccccatcctggccacaaaggcaaagctgaggcagtccatgccatcaaccaacaagtactacaggacagtgaccctagtgcaggtgctgggtaatatgtgggcatgtggagtttggaggttcagaggaaaactcctcacctttcccaagatgttcagacatttatttagaagggaccgagcctttccttacattggaaacacaagactaccatgcaaataatcctaggagaggaggccaagggcctgtccagagtaacgtacagaagtcagagccttccttgacagggactttggctacgggaagagaggcacagcctgtggtctctcctggtccactctgagcctcccc

SEQ ID NO: 7955 - DNA, 377 bp, mus musculus
cagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataaactcagga

SEQ ID NO: 7956 - DNA, 377 bp, mus musculus; identical to SEQ ID NO: 7955

SEQ ID NO: 7957 - DNA, 377 bp, mus musculus
tcctgagtttatcgtcgggagaatcttcccttgtagtctcgaattgccttggccatcagcggggccactttcttggcagcctgttttcgggttttgtccgcgggcgccgcgtgccggttgctgctgccgccgccgctcacgctgccgccgtcgccgtccccgaggccggagggagcctggctgcttcctgcgggcttgggggctggctccatctctccatttccggggtcagcggctcctgcagacttctcttgcctcctggaagcatcataaggcgtcttggccacagagttgaaacagatcatctttgtctgtcggccgctgggtttgttttcacgtgcggatcggattttcgtggtcactactcgcagccgctg

SEQ ID NO: 7958 - DNA, 1007 bp, mus musculus
gaataataagggaaaaatattaacgttctgagtaagaggccatcccagtccctgcctgcggtctctcccaatcttagcttacctaaatcatctaatgaggagtcttatttttgagtctactttgtttagcagtagtctgcggtcacccctgcatactaattacctcgtacacttttttcacctctggtgggtcagtgaaagcagccatttctcggactgcattgggaattgctaaggtctctgttcagcttaaaccatgtcagttttttatagttgaagtggaaagggcagggattggaaatgaggaaactgagaccaggagaggcaaaacaactcgcctaataccacagagagctggaacttgaactcagacccactgacttacaatgttctttccatcacaacatcctgccccttgttgatgacagagaaaaatggagtgagagagtgcagcactggtgcattcattaaggtaaagttttagaaaagtctgaattttattttatcttggatttctctgtttccattgcccattgttaagtgagagtagtagttaaggaaaacaaacaaacaaacaagcaaacaaacttgctgtttaatgtttctgtttttgaacaatgtggatcattttgcccagaaatttctgacttctcagaatgttagagatggcccattggtttggccctttaactggaggaaaatgagggaggagcccagagtctttatcccagtatatcagcccctttttgatgagtttcttacctcattttgggggaaagataatgttattaatgccctttctagcaatttgaaaaaaaagacaaacatggcttagagtgaaatcctcggtgattgaaaatatcattagaaataagctcctggtgttcactctgtcatttccaagtgttctgatgagtttcatttgaatgctgcactatacggagttggctgaagcccacaactatgtgcgcgtgttggcgacgaggcctcttccttgttgaggaagg

SEQ ID NO: 7959 - DNA, 1645 bp, mus musculus
gtagttgaaaatggttattttcagctgataaacacagcagggcataagggagccaatcaggtgcttcctcaacacatggtcaagacaaacaagtacaggtacgattcagccagtctcacagtggaatctcatatgttaggattcacagaaggattatcatgcattgggcatctttatcttgacagcgtgcagcgtggccgagtcacaccacctcagtgaggctggttgccatctgtgtctggcatttgactgtcatcttgggatcttgcttcctgcctttctggggattcccttggcttgctcctgaggccatcctcccactcataattccagggctttgcttaacttctaagctttatattatgttacatttcttgttacctttttattatacaaataatacatgttgctagaaagtgtttgttgtcagaaaataaaactcatctgtaatttaccattcagataagatagggtatagctttccagattttacttaactacacataataacaggtataagaaatattacaggtatttcttatacttgttattatgtgtagttatagcagccccctactgtttcttatatctggtgtcgtctttcctatgtcttgacttgctgctggcaacatccctggcagttaaggaacctagaagctatagtgtgtttctagactttgttgctagtgggacaggagctatattagtcggcttctcactcgctgtaaaaattgggcagattgaatccaggggtgacccatgatcattgctggcaactaaaatgactccgcaatacacagggactgacatgagcaaccatcaggataaattagaataaatagaagtctaagataactgatgtttccagattcagagttagggacgtcaggaagacaagctgttaaggggttagaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaaggaaaaaaaaaaaaaagagaagctattaagccgtaaagctgttaacttactgactttgaggagctggtgggacaactgatgaagatatcatgttacacgtaaataaatgtagctatattactgaagatttgggaacttaatttttcaacatttccttcaccgtttaatgttcatgaacaatagacatagggatagaaaaaaatgttggcaataagattataacaggatgagttacgtatttaatattattttcagttgggaaaactgtcagtatgctgcttatttctgaaaattgcctgtatgtatgtacatctgtattctgtagtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtaagtatttaagataaataatgttcaac

SEQ ID NO: 7960 - DNA, 1034 bp, mus musculus
aggagctggtggactgggactatgaggagggagggagaagggaagaaggcaaagtagaagggcaggaaactgggctcagacaagatgatcgcagagttttctattttgcagaaatagaagttctggcgggataagatattcattctgtagtgaggctgtgtgaatgggttgctgaaggagacgtgaggtccttgggcactgaatttacccagggtgagggcagagggtgaggcagactggaaacagagccatgtggaaaatccttgctacttgttatggattgaattgtttccaccaaaacataggttgaagtcctaatccccagtaccccagaatgtgagcttatgtggagatagagtcactaaagctgcaattaggtaagttaaggtgaagttatcccagggaaggtggccccaatccaatatgactggtgtccttgtaagagggaagtccacgtgatgacccagagatacacaagaagatggtcatatgaggacagaggcagagactggggtgatgcaaggaaggattcacccctgcaagtttcagaggcagcaccgccctgctgacaccaggatactagatttgagcctcctgaaggcgagaggataaacttctgttatgttaggccggttagtctgtggtactttgttacagcagtcctaggaaattaacacacccctgttcccccttgattcagctccactcatcctttaaggcccactcagcctcagcttctccagcaagcctttccgatcccactggtcacactgacctcctctgtctgccttctcagaattccaatgatgcttgaagcctggcacaattatgcataattttggcaggtaatttcaatctgttttatgatttttcttcagctcgattcaagatttgtctttacctaaggtgtaagtacctgaacttcttgaatttctcgcaccgcttaaggcagtgctcagcatcgattagctccttgctcgctacttgtgaacatcttgctggcagttatgtgatacagtttcaacttgatcctc

SEQ ID NO: 7961 - DNA, 1407 bp, mus musculus
tgggatgtttagtgaaaataccttactgaggggagggggttggcaacccctactttcttggagtcaaagaacacgtcattgttcaggactacaaagaaagaattctcaatgggattactggagtcagtgagacttcctctcagtctgatgcttaatctggggtttgagttattcctccatttcataaagtaaaaactgaactgcagaaattttaaacaagtgttcaaatacttttagaagtcaaggatacaaacagttgtaggaccatggtctagcattattttgttcttgcatcccttataattttgtctccttgtgtgttcaaatgcctggggagtgcctgatagggctacctggccctgtgtcttggcagaagttctgcattgaggtttcagagcagcagaagtcccttgactccccattcatgctgccaggtgaatggcaaacagctagaattctactggctgaaatactttttagcttaaggtttcagtttttgttgttgttgttgttgttgttgttgttgtttgagacagcatcttgctctgttgcccagcctggagtgcagtggcatgatctcagctcactgcaacctctgcctcctgggttccagcgattctcccaccttagcctcccatgtagctgggactacagatgtgcaccaccatgcgtggctaatttttgtattttttagtacagaccgtgtttcaccatattggtcaggctggtctcgaactcctgacctcatgatccacccaccttggcctcccaaagtgttgggattacaggcatgagccactgtgcctggcaaggtttcagtttttgataaagaggaaatgcctctaggagaagccaaatctcagaataaattaaacagaaatgtatttctgacagttctggaggctgggaagtccaagatcatggtgcaagtagattaagtgtaatgagggcccatttcgcggtctatagatggtgtcttttgctgtgaccttacatggcagaagaagggagggatcgctttggagtccttttttctaaggacctaattttgtttgtgagggttctgcactcatggtctaataacttcccaaaggccccacttcctaatatcatcaacctgagggttgggatctaaatatatgagtttatgggtgcacaaacgttcaggcttatctcataaaaacctcccacactcacttacctgtgattcttctctttctggctggctagaaggagatggccccaaggtgactttcacagccacagggtgaagatggctgagcttctgtcagcctggttccctgaatgactgcatggaggagggcaacctcactgagttactgggccatgcagtactagtactgttgtgtggagcaagatgtaaagttctatgcttgagctattatg

SEQ ID NO: 7962 - DNA, 244 bp, mus musculus
ctgcaatgtacaggctgtcagtggtagcttcttagcctaatggagctgaacataatcttgaggtcatgacaattccagggtaggattagtataggtcttcataattattaactgtaaagcctaatagagtagtttcaacaattgctaacatcagcaattgttaacattttgtcattcttcattctttctctttctcccttcctctccccacctaccaactatttattttttttgctgaactatt

SEQ ID NO: 7963 - DNA, 189 bp, mus musculus
tcccatcccaatcaaatgttcccttaattcttggtcagcaatacatctgcataggtttgggaagaaaaagaaagaagcactttaaaaggaaagaaacaaaatgatgttttgtgtttattcttggttggttcgttccaccactgttttgttttcccagaattattcctcattttttgcagactcttcttt

SEQ ID NO: 7964 - DNA, 3931 bp, mus musculus
atgttcttaatagcaactgtatttctttaaaggcaaatagttatctacattaagtagcaaatacaactctaacagtccatgaggccagtacattctctcactttctgatagtgaaaaatatcttttctgggtgctagaggttgtctcaatactatgggctatgcagaaaaatgtggaagaactagcattttgaggggtgacataaagaatgtattggtggctcacgcctgtaattccagcactttgggaggccgaggcgggcggatcacgaggtcaggagattgagaccatcctggctaacaaggtgaaattccgtctctactaacgatacaaaaaaattagccaggtgtggtggcgggcacctgtggtcccagccactcggcaggctgaggcaggagaatggcatgaacccgggaggcagagcttgcagtgagccgagatcacaccactgcactccagcctgggtgacagagcgaaactccgtcccccaacaaaaaaaaaaaaaaaaaaaaaaaaaaaaaaaaaaaagaatgtatcgtgtttcttgatgctaaaactatcctaagcagttcaattgagttacaaagcttaataatttttcaaagttcaactagaatgtcttaggacgtaggacaatttgggggaagtatttccaccttaaaggaggaaatggtggtggcatggtctacagttattttatacccttgttctatagaagcatgtgtcctggggttcctgagtgtctccatactgttaacagctcctctggcaactacattgtaacagagtgtcaggagttggtgcagaattccagcatcagttccaaatgctgaaccagtaatcgatttcccaaggaaatcaatcccagcaaaagttgagccccaactctctatagcatgtgaataaaacagaaaacggctatcttagagaatacatggtaagctgaagaacgtaaattagacttccaataaatttgatgctttgtgtacttagaactcatataggcattatagatccaagcagtttcagctagcttttcatctctctcaaaccctgggcgaatgataaacatcaaagagaataacatgaaaagaaatatttactttgaccgttctaccaaatatatatatatataaatatatgaaaatatatatactaatatatataaatatatatgtaaattatatataaatatatatgtatatatacacacacacacgcacaattcaagcataataatatgctttagactgagtggcttatgcacaacataaatttatttctcatggttctggtgaccggctgagtttccctagtctgagattagggtgccagcatgatggttgggtttctggtgaggacccttttctgggctgcagactgatggcttcttgtatcctcgtacggtgcaaagagagagagataattccctgggatctcttttataagagcacaaattctatttataagggctccatcttcatgatctaataacctcccaaaagcctcacctcctaatatgatcactttggaggttaggatttcaacatctgaattttggggaatatgaatgttacgttcagtccattgcatacactgtacatatatctatctatctatctatctatctatctatctatctatcaatctatctatatatatatatatatctacataaatatgtctttaaatttgatatatttatctttaaaatattgaattctgaataccattggctagcaaaactatgggactgaaaataatctgctgatttctcatcttggcctttgagatcattaagaaccctgtgaactatctttatatgacaattatttttaattctaggaaattcaatacagtagtagaatgctatagaataacatgttcattttttgtgttcattttcgtcacataaattgacttcttaggcttcaaaatttggagagttttaatgttaatcctaacatcaaaggtaccttaaattttttaaatattatccattattagagtagctggtaggtttataaagaatttagtgtgctctgagatctgtatttttaacaagcaactcaggtgactcttaagcagatttgggaaccgaagtcgtaagcaagtgaactatgtaaatattgtaccctcttgtctttctttctattttgcctgtcactctctcctgcagagataataatgcataataaattaatagaggaatcaatgactagtctatggttagacatggactttataaagcaagcactccatcatttattaaagcatataaaatatatatcataacatatgttttaactttattgcaacaatccattttatgaataaaaatctcctaggtagatattttgacacagtcaagaaggaaactgaatctatgactgttctatgagcctgttagaattgatgaaattcaagatctaacatgcatgaaagcattttagatgtggagttagctgatattatttgggtggcttttctctcacatgtttattttgctattttgcttatagtcatcagtctacttgtccatctacccttgctgtaagaggtcttatttttccttccatataccaatccagtccccatcacagaccctgatgtatcatagaccccgaaacaacttgttaaggaaatgaatttctattcaaacatgtacacacacacacacaatctaggcaattttaatgctagcaactgaatcacaagaatggaataaaagatacattctatctctgatatgaacaactgcattactatttaaaaaaaagtgggccaggtgtaatgacttatgcttataatcccagcactttgggaggccaaggcaggcagatcacaggcagatgacttgagaccaggagtttgaggccagcctggccaacatggtgaaaccccatctctactgaaaatataaaaattagctgggcgtgggggtgcatgcctgtaatcccagtgggtggctgaggcaggagaatcacttgaactctggaggcggaggttgcagtgagctaagatcacaccactgcactccagcctgggcgacagagcgagactctgtctcaaaaaactaatattaatataaaataaataataaaatgtgcttacatagacttaatattgatgataaaaattttgaataacacgttactattgcatagcacatcttattgctcgaaatgagacctaggtatatgacatttgtcaacatacatcaaaagattgttgatttgggaaaatgatcataaggctgataagttttctcagttcaatacatttgagctcatgacatgttttgaactctgaccccctaaaaaggaagcgttaggcatgctaatgggataaatcagccaaatcccatctatctgaccttattaatgtaactctaggatttagattctgaccttccataattattgacacctatttaatttatcttctcatcaatagtgaagcctagtgcagctgctatggcacatgtaaatacatcactgttgccagcacaggctgattggcattcatgcttgagtgtcttttttattttctccttggctgctgggagtagcctgagcagcgcagacactaaagagcttcatctattaggcatgacagatttgtattcagcgataaacgcctgaccttgctctactctctcatccattcccatcatcccctcgccagatgaaagagtctgcttaactcctgtttcctggctgtttccttggcaacaataactgagtcagtctgacagaataactaatagaataccttggtagtgagattaaagtgctttaaaaaaagtcgtcacccacagaattataaatgagaaatgtttaaaatcggaattttaagatgataccaatcagtgacattatgatttccttattaacccatttcattttgtggtaatatttacagacttttc

SEQ ID NO: 7965 - DNA, 1250 bp, mus musculus
tggtcagaaagttatttccttatagtgacttattttgtccattcacttgtacctagaggttttaaaagacagacacattaaacctgtggctagaggtggggcttacagaagcaagagtgacagtcttcaccatcaaatgcagttgacgtttgcaaatgacaggagacaaactggaaattgtattccctcaattcctagcagctgattccgactcattcataccaatattgtaactgttgtcactcttcagagtccctctgggacattagtactaggttgtcagttgtcctgtagttaggcatctatgacgtgaacaccaataggaacctataattgctagaaactcttattcatttgttttagtgtgttgaaatccattatatttgtaatggattttccaagtctcactatttgccagacaccctctctgcacccttgcttctcagcttattggaacagactgacgggaaaactatgccgctctcttggtttctagggtggaatttcaggggagaatgatgggagaggccaggtaataaaaaagcctccttccagagatgatataacttggcagccttaagctcaagagatggaggtgggatcaggatgaaataagagcatgggaaatcaggattcatcacacaaataaattttccattaatgtttgtggattaaggataataagggaaagaatgccagcaaaaaacatgtatattttatgcaggaaaggcaataaaatttgatattttgatttttacactccttatcccacatctgaatataattgtctaggattgcaggaattattttctgcaagtgttgctggtaattcttcatccagtcttcttccagtgtgggtacagttacgaatattgccacctagggctgacagctgctttcaactggacaaggttttatggtttctttgtctttcccccaacccacaaatgttctcaaacctcttgcatttatttatgttattttactttgcatgaatgggggaagaaacagtgttcagcaattcaatgatggctgaatggaataacagaatttcatttcctaagggaacatttgagagtgattgaatcaccctcaatctacaagccacatttttgcactatttttctacttgactaattgattatgacaggtgtcacccaagctttgcagcttaggctgtccccatgctaagacagagccatagcaagcaacttctattgatgaaatagaaaagctatgcatggttattt

SEQ ID NO: 7966 - DNA, 1042 bp, mus musculus
ataggctttttttttctttttgttaaaagttaccctttagaatagtaatttttggaaaactagcccttgatgctatatgtgtatgtttttttgaaaaatacccttaggtgaacttgcttttctaggccgccattcttttatttatagaattgaaagtttggttgcatgattgttacaatcttcccaggtctccaaatgcatatttacctctgtctcagtgctatctaggaaggaaacctcttcctggaatagtgggtagagattcacaaaatagtgtgaataattgtggtagtagatctctagttgtttggaactggccacaaagagttgtatttgttgagtaggttagaaacatgtcagataatagctacaggcacacagcagcagcagcgatatttaaaagatatcagatatgtaaattagtctgttattcttgtgttctagaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttt

SEQ ID NO: 7967 - DNA, 740 bp, mus musculus
agattgagctggtgaattggcagatgctgtggtaattctgcagactaaagtattagtaactgatcaactagcctgagcatttttccatcgagaatggtgacattattttctaagccaaatttagccaactaccaggataagaggtgggcttataaataactgtaggttcagcaaacaggtccaccgttgtaaactaaatggccaaagtcaaagatatatgatagcaaaagatcttttggttgattgcaccttaataattttagagtaatcattaatgctatattgcctcctgagtcattgccttcagaaataagacaccaatatactattcagtccaatttccagtcctccagcctacaaaaatagactcagtacatagaataaaatggctcacaattaaggatttagacaattcacagggatcacagacaacagcttgactccttaaaaacatcttattgattaagctaaatggagtccagtatttgccacatgaacatgtgtgtgtgactgtgaaggaacaagttaggtcaaatgtctaatggcagaagacggctatgtgaggaatagctctaaactaaactaattcgttcatcacagggaaatttagttctggttttctatctgtacttggcttatctccaaatgataatttcaagtcagagaaatttagaaaacgaatgtggaattggttttcccacttgtttgtaagaaaagatatgtaaacagtttcttgctta

SEQ ID NO: 7968 - DNA, 1565 bp, mus musculus
ctatagagatttttatgttaggtcttggtcctttatatcattaaaatattaaataggaaaaatcatggaatttattcataaatagatgtacatctatttccccagactacaggtaaagaactatttgggtaagaatgggctgctgacctgcaaggagaaaaatgagagcttcagtttaaaactgtcatagtttataaaagatataaaccattcagttcctttagtttttaatatttagaagagtaaacaaaaatttgattcaattaaatgtaacaaatacaattaaatggagatgcaatttgatttattgaaaataacatgattttaatgcagattaactgtaggcagtaccttaccagaatataatgcattctggaaaatatctactgactcaaacatgtaaaaccataaaaagatttcatggtatggcggggagaggggataggaggggtgtctgttcccagggagctaaaagtaatgtaaactctttaattacttgctgcttttagacataatctttgatgacatagatctagcatgttatacatattctttcattttgttctttcaaaaaaagtatcactttgattagaaataaataagaaatagaatattcaaataatggctcaaacactgcaatagaaagacaatgatatggacaaatggagccatcaccaggccagcagaacgtctgggatttcattttagatgttgagtcctgagctgatttttcaaagcatggatttggcattgtaatgctgccagctcagaaacgtcgatgtaatgggagaaaatgtatggggaattcagggcctgcctgaacctccatgggcccagccttggtacactcgggctagagagatctgtgaagggctgtttcacctcctggtgaccactcccacaccgacattggttggagatcctgccaactatccagggagcctgtggatctctttccaatgggatgctagcttttagtcaactgtttaaaaaattattatctttaacagctcttgaaagattagctttctattgccatttccaaatcttctttcctcccactctgcaccagcacctgcactataaagaaggtaaattggccaggagcggtggctcatgcctgtaatcccagcgctttgggaggccgagggagcgtggatcacttgaggtgaggagttcgagaccagcctgcccaacttcgtgaaaccactgtctctactaaaaaatataaaaattagccagacgtggtggcatgcttctgtaattccagctactcagaaggctgaggcaggaaaatctcttgaacccaggaggtggaggttgcagtgagctgagatagttccactgcactccagcctgggcgacagagccagactctgtctcaaaacaaacaaacaaaaagaaggtaaatcactaggggatatatagaaattatatgataaaatagactttagaaaaaacctttttgaaaccatttacaaaaggaaactgaatagacctctgacactcttgtctccaataagctgtgaaaatagtactggttccatcacttaagaggcattcag

SEQ ID NO: 7969 - DNA, 632 bp, mus musculus
agcaatgtgtattgctggcttcccacttctttaaatagcacttgcagtgagtgataatacaacaacacagggcacagtgtgaacaaccaacaagagaatcatttaaacaagtggatttgtaaaacatgattgttttaagcccgtccatgtcaggactgcaatttgaattaaacataaggtgacttctttcactgaatcaataagtgcaaataatatcgctcgcaaccatgttttatttcacagacaaaaattgttcttaacagctttctgaaggctatgcttcagccacctgctgttaaagttgtttgctttttcttacaaaaattgttctcttgcaacattgaaacagacaagcttgcagtcagttagttcacttgaggctagagtctagggaggtttgaaaggcacttttcttaatgaacaccataacttcctgcacccttcctgctggcaagtcagaacaatagacagatcagaggggtgtgcctgaagccagttacttctaaaagtcttactagtattagctgacttgaatcaggggcaatttctaccactttcacaaagggagacttctagtggtccacctgtttttgacttctaaaaacattggttttactggcagataatagatt

SEQ ID NO: 7970 - DNA, 388 bp, mus musculus
atacatcctaataaaatctacattctatagtctcatgagtaatttattaaatgtttttaactcctattctatactgggtctttgctaggaaatacagattctgtaggacctcaaaaacattgcttggggaaggagacatccatcaatccacaaatgcaacaatgaagttacatacaaggcacagtaaaagcacaatcctgaaggagaggagagccacggagcagcaaagcttcttgttagacacacagactgtggttctacagccaggtcccatccttcattcttcatttactaattgtgtgaccctggctaaatgtctttacttctaggtacctgagttccctcattgataagatgaggatcatacttacgtcattgggtatcatga

SEQ ID NO: 7971 - DNA, 388 bp, mus musculus
tcatgatacccaatgacgtaagtatgatcctcatcttatcaatgagggaactcaggtacctagaagtaaagacatttagccagggtcacacaattagtaaatgaagaatgaaggatgggacctggctgtagaaccacagtctgtgtgtctaacaagaagctttgctgctccgtggctctcctctccttcaggattgtgcttttactgtgccttgtatgtaacttcattgttgcatttgtggattgatggatgtctccttccccaagcaatgtttttgaggtcctacagaatctgtatttcctagcaaagacccagtatagaataggagttaaaaacatttaataaattactcatgagactatagaatgtagattttattaggatgtat

SEQ ID NO: 7972 - DNA, 508 bp, mus musculus
atctgtggggcttggttgcagaaggtgtaaaaaccactgacatcaactccattgggggtagtcctttaagtttagaggattttggccttggctaattcctcatcatgcaagctcctgctgttgaaactgaccgtaagttttgtcaattctgctggaagaataatctctcctctgttttggagcaaatctctcattcaacgtttttggtggagatttgacattggaaatgtgatcgttctaatttgcttttgttaccaagcactgtctgtcattgaggacggagatgggaaaaattagcaccctcaccttgttgcccccatttctgccttgcttagaatcgaggctattgctatgcaccaaaaatctgacttttgtcaagttatcatgtttgcttcgataagtcaaagacataggcttggcttcctgaaaatatcactaatcatatgttagcaactccagaacaattcaaggctcatcttgttctctaaccatgcattcaagaatcttc

SEQ ID NO: 7973 - DNA, 261 bp, mus musculus
aaacagcaggtgtaaccagttgtccttgcctatgcatgtgagaatttggtcaaacttgttagattttcatcactacaatcaagttgtatggattgttgtcactttgtgtgttggtttaattgccaataaaatctttcaaagatttcaaaatgtctcatcactgaaacgaaaagttattgtgttcacagaaaggaaaagaaagggagcagtggggcataacatgatattagtaaaacaaatagtcttcatagagagaatgac

SEQ ID NO: 7974 - DNA, 2675 bp, mus musculus
aatgaagaatggatccacttcatataattatagtaaaaaataaagaaataaggaataaaaattaataaataaaccttgactcaaggaaactaccaaataaatagttaactattattattttaggttatataattatttttatttgttattttctgctgctaattttattattttggaaatgtatatattttaaaattccccatgctaaaatccacttcttctttttttaggcttagatgagatcctttaaagaccttttccccacctctgttttataaatgtctttcacttgtatgcactaacgagctatttcaaatttaagtagtgtctatctgaaatttagtgtaaggtcatgttgtgagacagggatagagtttcttttttccttccaagaattctttggtttttcccacgttttttgtttaccaattcttaaacgtgctatgtttaatttgaagaaaattattgtaggcacagatgagtttatggattctcttcttcgtgccattgttacctctctctctcatttcttctgaacttttattaatttaatgtaaacttctagtcaagttttggggttgattcagtgatgtacactctgctccccactgctgggcactgccccttctgatgctgagagctgctttgcccaagtttgctttttctcagctgtgtaaatataaaaagcttgattatccacatccaacttgggacaaccctgaagggttcttcaggttccagcagacttcctttaaggttctttgattttctgtggggctatattgcaactgcacttctccttgagtccgctcccacctcctttctctccctttcacagatgtggctcccaaaggcaatgaaatcatctcagagctggcttctgaaaggacccaacttgctacacagttaatatttgataaggcaagcctccatttttcctccttcaccttccaatgctatttgattaatttattgcaggtttgttttaatttaattttataacatggatataagaaagcaaaagggagagatgaatgcaggaacaaaaggcagaagaatgaaatgtgatccgtgatcttagttttcatggacaatgaggaggttcccaggatcatgccttttagtgctaaaatcttaaagtactgagcaaaccaagagacaagctatggaatgcattggcggccatttaatactgattcttttagtcacagagaatataatttccatacgtattcaactatttattcacacagtttaatagtgtataatggtttttattcataatgattcaatgtaattattacatttattcctgagaactttatattgttaattacaattttttaaccatttgtatttttgacttggtattgctgatatagaggaaaatgatttttggtggttgactgtgttacttgataatatactctactttttcattcagtagtatcctttaaaaactgagtgtcttagattgcccaggtagacagttattatctcttttgtagtcaccataaaaataaaaaaatagctacaatttattggtagtgcaagggcaaatacaaaatttttaagttttaactctctctgttgaaactatggataagacttttctttcctcctttttctgaaagccctcactttagaaaatttgtaattataaatactgtctccttcctttgaaatgtgtatacattaatttaaaaactagataggccatttatgagctctatgacacagaaatgtctttcttaaggacctgagtgccatctttgaaatgtaaatatcaaggggtatagcacccctatttttcagtatctattggagtttataaacataacttcagtgatgccttgatccaagttgcaaaaccacttcttgtcataatgatatgaaaagtttttagtttcctctggataaagtcaattagctaacatagatggtcatatctcatagaatgtcaataagttaaaagaaaaaatagcttgatgaacaaataactttggtaaatactgtataagataaagttaacaagtcactatattgaaaactgtatgagtagtatttaaaatgattatctgaaaaatcagtctccaaaaaggtatagtatgtaggctccccaaatatttgacaatggaagaaaatattttttcctacatttcctcattgaaatcatgacacttaaaacaggccatgggaaatgctgatttgcactgtttacttattgagtcattccacaagatgaattgattatttaatttttatgtatcatctgaataactgatgtgtcttaggaagtgtccatttcttaaagcaatatattaaattttaatttatttcccttgattatattcctaattttgcatattgaaaatatgttaaagatttaaggattttaattatatttatgtatttcactagcttctggagtaaggtgcttactaaaagtagaaataggaagggaatataaaggtaatatttaagagcaaaaattttctgtggacttctgtaccgatcttccatgattccatagcctttggagcagtataatgaaagttgtgtctgaatgactcgcttatatctaagttgaagattctatgcgtcaaaattatctctcaagaagagaatggttaaatacagcagaaatcttaaagactaagctcttcaagataaat

SEQ ID NO: 7975 - DNA, 1159 bp, mus musculus
aagaggtcattagaattgtgttaatcactttacagactcacaagtcttcttaagtctacttttattgatttaatagcacagagctttttcctttcttataaaaggataattgtaaagcatctatattactgcaatttacccttgaattgactctagtgtttagtgtccaatgaagaagagagggtggagagcacgcggagttggccactgttcagccttccttggcctaaaaatcaaatgactgtctctcctgggcactagtgtctttactggtttccctgttattcagcattttgcttttttgatggcaaagctgatataaactcctcagagtgtatactgatataaggaagtgaatatatttttgtgttgagcaaatacttttttgtcagatctttcagaaataatttataaaatactaaactcacaaattgttctgtgctgtggatatttattgctgaatggttacaatcttcctggatttcataaggttttacatttattgcattaatagcttgtatcacatcacagttctctctctcttacacacacacaaatgtcttttacttgattggaagtcttcaaagccttagcttaaattggaagtttcaggaacttctaaaataactaacatgcattagttgattgcaaagggtttgagatggaagctttttcttccttggatgaaggaatcagatgctacttggtggggtgataaaggggagctgaggacaaggaaagaagacatgtgatcagagtcttgtgtgtgaccatctccccagcgtctgacaagcagagcagatctagctgtaaccagcaatacacgagtgcctcctctggggatttgctggttctgcagaaagatacccctgcaagcacttcccccttgtttttctgcaagtctcacagataaaattaccagttcaaatgaatatgcagacatctgtccatatcttcatttcagattatagtatagattttcattctggtagaatctcttttctgctattttgcaaagtgtttattgaaacctgctgacttttattgaagtcacataaatcacacgtggcccaaggtaaatacaagggcaaattaaaaattatagttgatacagctaagatttcttgtaagaataaattataaaaaactctctgaatat

SEQ ID NO: 7976 - DNA, 1159 bp, mus musculus; identical to SEQ ID NO: 7975

SEQ ID NO: 7977 - DNA, 566 bp, mus musculus
gaatactcatatatcaaccttaatttgtatctacattgtctaatatgattctgagataccaattaatttaattatgtactattttatcaactaattctttagtttgtgaaatacagttgcatttagtaatgaaagaaaaggcaaattcttcagaaggtgtttatacagcagcattctttttctgaatcagcaaataatgcacaatatcagtgaatggattattctccccagagagtagtcctcattatcctgctgcgtgtataattgggattgtattgcatcacattattatttaatgactattgaaaactaattgtaatctcaaatccatagtgaatatagaatgtatcttttatcatggcatgtgtataatctaatgtattcttcttttctgcttgagtattcagtattgtggagtcacaaaagtgaaaacctgcaagcactcaaaataatcatttcaaattatcaagaacaactagcgttttttcacagcacagtggcctatttgatgactctacaaacccagaagcacaggaataggtctgtagaactagtggccaattggt

SEQ ID NO: 7978 - DNA, 874 bp, mus musculus
gcactagaaacaacgttgccaggagagaatttaattcaccttggtagtgacatatggcaatgagacttgtacaagatgaccctgtattatatgaatcagatatatatatatatcatttttaaatatatatatatgatttcatataatagtatttatatatatatagtaacaataagataacaaaaaagataaaattctccccttaggaagagaaaaaacatgtcacatgttaatctcttttccccaattataaatttttctaaggcaaaaaacatgttactttttgtgactaatttctaattgttcaataaatattaattaaatgtcaagtaaaccaatgttactaaaaagtatgtatgttcctttttgtgggggttgaaagagatgttcatttgcgttatggtaagatgttcttttatttgatttagcagaatgttttcttgagatttcagtgagtatcacacaagagcaataaaaccatgtatatagaaagcattatgcctaggtgcaactcagcaactatggtacatgcgatatccctgaaggatcgattttaaagtcttgttatatttaaacacctgtgtaaaatgatcttggtttgcagttacagagggctcatttacattttaatgtggacagtaccattttggatgccattgggccctgtttagagaagttcaaggacattcctcaggagtcttttgacatattacaagtgaggtttgtagtgaatgtagcagcacataaaatgaaggcactgtggtttacatcctaaaatgtaaatgtgaagaaatccgtggatcttattactttatcataatatctaaatctctgtgtaaaaggcagcagggtatgagcctgaatacagattggt

SEQ ID NO: 7979 - DNA, 491 bp, mus musculus
atttccaattacagcagctcttgcccagaagatatcaaaactgacatcatgtttcttcgcaacaggtctaataaactgaagctgataaggaccacagactttcagtgaccttgggatgccatactgttactgagcttaatgaaggcactttcctatccagtgaacaacaggacttatttgtcctgtgtatacactggactcattctgtcttatcccaagtgctattattcaatgcttaattagcctagccatcatgaatttctcctttctagtacttaaaatctcctaaatttcccctgtagtaattactcaattaattcattatcgttcttgttttcttaaagctttgatttcaaaaaaaaaaattttcttatttgaagataaattttaaaagttgtctgtagaccattacttttttttttctttttgatggagtcttaagcatggtaaagaaattgcctaccttagggaatggaatttatagcagtaga

SEQ ID NO: 7980 - DNA, 1112 bp, mus musculus
aaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactc

SEQ ID NO: 7981 - DNA, 209 bp, mus musculus
aattaatttaccttttttgctaaaacagttttaatggtgtataatgctgaaactgacaagatctctcaattactgttatatttcactttccgtacagcaagaattgcttaattatattagtttccctttaatttaatggatttgtaaaagaaaagcacctctaatgaatacacaatcaattttgtgattcttctttttacaatttgcat

SEQ ID NO: 7982 - DNA, 285 bp, mus musculus
catggcccaaagtccttatgacatttcaggtccagtgctcaccaccagctcatgaaattgatgttagtaacctttggttgagtctctgcttggctccagtggctcctcagttcatttttgatataatcagctatgacaggaggccatattcaccaggtacatgcaggattatcaggactttgcagaaggggtgagtgatatttcaggatcttgtaagatattgtggagaagcagttaatgaggacattatatttgtttgttaaactttatgttaagataggatta

SEQ ID NO: 7983 - DNA, 203 bp, mus musculus
ggaggcctagaatgtgacaaggattatgctgaatttggagaaaaacaaactcatgactttaattgatgatgtttaatactaaatagcatttggtaggataaaaatgtgtggatgatacagaatattgcatgagttacttaaaactcatacaatataatttaaattaggtaatgttaaggatattgtcacctgtattaaaaaga

SEQ ID NO: 7984 - DNA, 388 bp, mus musculus
ctgaaaactctatttgtgagcatctatgtagctactgtactagttaatgaggaaatgatgtttatccaaaatattctccactctctaattataagctgtccagcctgatactccattcctttcactgctttgcctttgatactcctgcatgcacacgatatgctcatttattccttacaacagagtgctgactttttcagcgaatagctgagctacattaaaatcttctcagactcagtatacctcagactgtttggaatgtggatgagcttttgcatcactgataatgcaccgcttttctagcttcagcaattctactcattcatttctacattagttctgaagagcattttatgtaacttttcaattatgttaaatgttactttga

SEQ ID NO: 7985 - DNA, 1207 bp, mus musculus
tgtgtgtgtgtgtgtgtgtgtgtgtgtgtgtgtgtgtgtattttaagctgagatgctgggcaatggggagggagggctatttttaaggctgctcagtggatttttttggtgaaaaacgagaccttgtatttatttttaaatattttcttaagttattataagcctgtaaaaattctgtgctcagcctgctttactttaagtttttaatacacattttgactataatattaatgtttgctgcgttgcttcttcttttgtccgtttgttgttttcactctctccaacctatagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggtcagtatcaatagattttttgatgacaactataacctgaagactgaaatacttccagagtattgtcttctattttgtcttcatatttcagtttccctttaattaatgatttaaaccctagttttccaatagtttccctcttctttttccttttcactgctatccatattcttcctaaacctcatacatgtgcacgatatgtatgtgtgtgaacacacatgcacacagagaccaaagatactttatttatttctaaacatatacacatatttattttataaaatgatggcttttaatttataatacagatttataatgcaaacttacttccatgtgaccattgctcccatcaatatt

SEQ ID NO: 7986 - DNA, 1207 bp, mus musculus; identical to SEQ ID NO: 7985

SEQ ID NO: 7987 - DNA, 770 bp, mus musculus
attattgagatttggaagggaacatactactagagatagtaaaacagcaaaactaatctaaaatgtcagtacagacagtccctgatttatgatttgacttacaatttttcaactttatgataatatgaaagtgatacacattcagtagaactcatacttcaaatacccatacaacctttcagtttttcactttcagtagagtattcaataaattacttgacatagtcaacacattgttataaaataagttttgtggtggatgattttgcccaactgtaagctaatgtaagtgttctgagcgcgtctaaggtcgggctgagataagctgtgatgtttggtgggttgagagtattaaatgtattttgactgatggtattttcaacttgtggtggttttactggaacataacatcattgtaagttgaggagcatttgtatttattttattcggggaaagcttaagacagtttattcacaatggtaaactacattcttggtggtactagaaagaaaaacaatccttttctgatggcatttgcaactggaaataacgaatcctttaagcttcagagactggtgtaagaggaaatgggttttatgccccgaggtccaaagcctgagttaatctaatgaccacacattccatttttatgtagaatgtttcagagtgcaatgtatttttcttttttccatcttctaaaatctctagaatgggaattaataagttagtcttgaattacaactgaattacttttcagaatatttgcatgt

SEQ ID NO: 7988 - DNA, 1118 bp, mus musculus
atttccagataattctggtctgatgtcattctatgacaggaagagtgagtcttaatggcaagaataaaggacaggaatgtgggccaggaattgatccatcataagaggaagggctaaggaagaggtcgggcccccagagaaaggagtggaaggaagggaagtcatttccaggctgctcgggtgtttgccctctgcaaagaccaaggccctgccttcagtcttccaccaaaacagcagctcagagagggctcggacgggcaacactgccaggtgctctgtgtcacagggcacagtgcagggtcagcctcgccatggtcacccccgtcaccatcgccatccctgccaccatcaaacccttcccagacactgacgtgcaaaatgaaagaaaatctttttaaacctctgacttaaatgtttatcttctaggaagatagaactaaaatggtgcacgtgtctgtagcattgccttgaaaatcatgttttgtggtctctccagcagatggcaagcctgtggttgatacactatatccaatttattttgaaatcctcacagaaaccagccagccttgtttgtagcacaaatgtgttcagacataagaagtggagtgaatctaagatgaaaagctgatgatctgtgggttgggatgaccgtgggtcattgattactgtatggacatggagggagggtggtaggcttctgatgggaaagaaaattgtcttacaaaggtggacatgaagtcgtttttgaatccaaataaataaacaacaaagacctcaaaaagcaagggtgggttgggggatatggaaataatcttgagcatccccaagcttgtcatgaactttttacaagttatttggaaaaaaattaagcatattaatttgaaactagaaaccaacttctcacttttccataatctgagtaaactgtttgaactttgagagttgatttagccttttgatgtcaaaaataaacgtcatactataaaacatgatatctatccatacaacactctcaactattgctttcagcgtctctgcagctaccgacccatctgcccattgattcctccctccatcatgcatttgttctcatccaaagaacactttgccttctgctc

SEQ ID NO: 7989 - DNA, 1054 bp, mus musculus
ttaaaataccaagtgaatacacctagtcttgccgtctctatttttttccttggggagatgtcagagaagcccagacaatggctgatcatctaaaatgaagtgtggggtaaagagaggaataatggtagacccttagagaacgctcattttcagacatgagaagaaagaaggagagttcggaaacggactgccgaatgtctgggggtgacaagaaacaccaggacaatggaatgtcactacaccgccaaaaagtgtggagccatttgtgttccctatccttctcaggagaagatctgggctggaagtgctggtttatggtttgttagtgtattagtccgttttcacgctactgataaaagacctaccggagactgggcaatttacaaaagaaagacgcttaattgtactcacagtttcacgtggctggggaggcctcacaatcatggcagaaggcaaggaggggcaaatcataccttacgtggatggcggcaggcaaaaagagcctatgcagcgaaactcccgtttttataaccatcagatctcgtgagacccattcactatcacgagaacagcacgggaaagacccgcccccataacgcaatcacctcccaccgggtccctcccaccacacgtgggaattcaagatgagatctgagtggagacacagccaaaccgcatcagttcggcaataggtactggtcagagccagagaccaggatgaccctgccccttccgctgaggtctagagtgaccagagaagggaactccagggtaaaacagagcggcaacccctaagaacctgggggcacaaacagcacaaagaccatttaatgaagcattttcagagtttaggatatttccaacaaaatattttccccaaaaggtatctttaataatattggatgcgttgatttctaagagggtcctacagagacacattccagtcactggtctccctttctcccatgtattggtattttcaatacataatgtctggagcagagcatggaaatggcctgaaaatatcctctcctttgcatacgggaacacacag

SEQ ID NO: 7990 - DNA, 3839 bp, mus musculus
gtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccagagtgcaggtcgggcacctcttaccccaaacctgaagtactgcaaggcctggagcttgagccgagggctgctcaagggagggggtcgttggacactttggaggttttggctcaggggatgctccctgtgagaatgtataatgcacacatttatttatttatattttttgaggcgaagtcttgctttgtcacccaggctggagtacagtggaacgatctcggttcactgcaacctccgcctcttgggttcaagtgattgtgccacctcagcttcccgagtagctgggactgtaggcacccacaaccacacctggctaatttttgtatttttagtagagacggggtttcaccatattggccaggctgatcttgatctcctgaccttgtgatccgcctgcttcggcctcccaaagtgctgggatacaggcgtgagccaccgcgcctagccacatttatttatttatttatttattttacttattttgagatggagtcacgctctgtcgcccaggctggagtgcagtggcgggatctctgcaagttctgcctcctgggttcatgccactctgctgcctcagcctcccgagtagctgggagggactataggtgcccgccagcacgcccggctaattttttgtatttttagtggaaacggggtttcactgtgttagccaggatggtgtcgatctcctgactttgtgatcaacccgcctcggcctcccaaagtgctgggataacaggtgggagccaccacgcctggcctaatgcacacctttataatcccagtactgtggggggccgggcaggggattgcttgaacccaagagttaagaccagcctgagcaataaagtgagacctctgtctctacaggaacaattggttaaaattagctaggagtggtggtgtgcacgtcaggtcccagctcttccggattgggaggttgaggtgggaggttcacttcgcgctcaggaggttgaggttgcagtgagctgtgattgcactgccagactccaggctgggcggcagagtaagaccctgtctgtaaaaattacataatgcaagtatttggaaatgcaggtacatctggccccaagcatgtcaaccagtagtaagccctttgatatttaacacgttacttgtgaaatgttatcagaaaatcaacaaggggcctggcagagtggctcacgcctatcatcccagcactttaggaggccgaggcaggcagatcacctgaggtcaggagttcaagaccaacctggccaacctggtgaaaccccgtctctactaaaaataaaaaaattagcctggcatggtgttgcgtgcctgtaatcccagctacttgggagactgaggcaggagaatcacttgaacctgcaggcggaggttgtggtgagctgagatcacgccactgtgctcccgcctgggcgacagagcaagattccatctggaaaaaaaaaagtggaggagcgtggtactctgtttctgcaaacttgtagatgcctggtttcgttagaagctgcttcagaccattgtggacatgatttgataccccatttctgggctcctaaaaggccctacgccttccccggctactctgaaaactagtctggggaaagcctcgcggacctgactgggcgcccccacccccacgcggccccaggctcacgcctttctcctcccacaggccctcagtctccgaggaggatctcaaggtcctgttttccagcaatgggggcgtcgtcaaaggattcaagttcttccagtgagtatgaggcgggctgtccctggctctccccaggctgccctgcggccggccctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactc

SEQ ID NO: 7991 - DNA, 606 bp, mus musculus
gttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacgg

SEQ ID NO: 7992 - DNA, 1841 bp, mus musculus
tggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggaggtgaggcacggctcagcatgtgcagaccacacccgtttccaggctctagagggacctcatggtcctgcctcccgagacagagaccctaatggggccaaggcgggcaaggccccaggtccccctggtggagacctgcaggacttggcaggtggagggcaagcagccgaggtgtgtccggcccttgacggtggctctccccctcccccagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagtgtgagaagggctctgggcctggagctctgaaggcctacgccctgggccggtagagcagccgagctgtagcacagggttgtcccaaacgagcagcggcatgaggcccatgagtggcctgctaggcccttcgtgaagtgctgggcaccaggccgagtgtctggtctgcagggtgactcaggctgaggaactagcctgagctcctgacaggactttccttctgccctgccaccttctcgatggcccagtgagcctctcgcttccctctgcaggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttcta

SEQ ID NO: 7993 - DNA, 2217 bp, mus musculus
gcgttgcatcaccatcaagtcaacgtgagctccctgtgccctctgtacccaggcagggaggtgctggcctggcagctggaggccactgggccagggtgcgcggggagagacttggcaacgtctctttcccctggtttcttaattcatgggagaatgagtgaggttcagtccagcgagacaggatggagaggcacagggattcggggtactgcgagctggaaggttttcttgaggagggggcttaactccgtggttctccctccctgggggacttgcccccactcctacaatatctggagaggtttggctgtcacacctgggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagtcaggtgtgatgaatcttgggaccaagtcggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagccccgaagggaagaagctgccacgcaccttctgccagctgatcctggaccccatcttcaaggtga

SEQ ID NO: 7994 - DNA, 2217 bp, mus musculus; identical to SEQ ID NO: 7993

SEQ ID NO: 7995 - DNA, 963 bp, mus musculus
acagaatgaagactgtcaagaatcagccagaaggttttgggggttaaatctctgggatgcttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttt

SEQ ID NO: 7996 - DNA, 1013 bp, mus musculus
aggagcaaatgctatggaaacatgaagaaagggaggaaaggagggttggacaggggtgtatttgagcaaagacttagaggacatgaggagctgggccctgtggatgtggcagggaacagagagccaggcagagggaatgattaaaatacaaaggcctggctgggtgcagtggctataatcccagcactttgggaggctgaggcaggcggatcaccagaggtcaggagttcaagaccagcctgaccaacatggagaaatcctgtctctactaaaaatacaaaaattagccgggtgtggaggcgggcacctgtaaccccagctactcgggagactgaggcaggagaattgcttgaacccgggaggcaaaggttgcagtgagccgagatcacgccactgcactctagcctgggtaacagcaagattccgtctcgaaaattaaaaaaaaaaaaatacaaaggcctatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgcggccagaggctgaggtaagctgcttcgggggacccagcggggtactcggtggagcacccgctcctggcctcctcggatcccagtgctgctgaaacaccaaccccgtgtttctgttttagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtct

SEQ ID NO: 7997 - DNA, 3103 bp, mus musculus
aaatcctaagtaatgcactgaagagaggagagatcattgcaaagcagggaggaggtaggaaccgcttagtttgatgttttgtttttttagaacaggctgttatcgctggggactgtagagcttagtggtgagaagtgcgggttctgacacagactgcccggggtgggagcagctctgcctttttctagctgtgtgacgtttggcaagtcactgaacctctctgtttctcatagcactcatttgtaaaatgggggtgtaatagtacctgcctcagggatgctgtggagagtgaatgcatgtgaaagagtgcttccgcacgtgctgtgcacaggccgaccatcttcattgttagagtacctctcttttgggggttttgttttccacattataaattcctaaaagtaaatatattttccttagacttgatgataagactgaaagcacaccacccaacaagtaataaatgcttgtaaaatagataaatgtactcattaggaaaatatgaagaaagtatggtctgaaaccccatcgcccagtgatgactgccggaaacattttgttctgaatctttcattcatacacagctttatggatactgagaacaaaatgtactttttgagcatttttggagacagtctcgctctgtctcccaggctggagtgccgtggtgcagtctctgctcactgcggcctcaacttcccaggcctaagcgattctcccactttagcctcccaagtagctgggactacaggcgtgtgccacctggtttggctaattttttgattttttttgtagagatggcattttgacatgttacccaggcttatctcaaactcctggcctcaagtgacctgcatacctccagagtgctgggatgacagatgtgagccaccacacctggcccaaatgtactttttcagcctgattttccctctgagtatcttggcatctcacctcctgacttctgtgttgggctggctctggagctccacgctggtaccatttcctcccatttctttttttttttttttttttgagagacggagtctcactctgtcgcccaggctagagtgcagtggcacgatctcggctcactgtgacctccgtctcctgggttcaagcgattctcctgcctcagcctcccaagtagctgggactacgggcgcacgccaccatacccagctaatttttgcaattttagtagagatggggtttcaccatgttggccaggctggtcgcgaactcctgaccttgttccgcccgccttggcctcccaaagtactgggattacaggcatgagccaccacacccagctgccccacctcatttctgatgcctttgggcaaagtgcccattctcgctaggttccttatactgtggggaagttctgagacgtctcccctctgaaagtcacacattcttagagtcgggcctgctttggccgctcactgtgtgctgtgcagctagagaagcaggcgcggtgtggccagttacagagccagttagagaaactgcccagtttcctcttgaattggtatctttgactaggctgcttgggtcggtcacaggctggctctgggctgatggccactctcagaggcaagcgacagggtttcggggaggagccccaaactcggcatgtggaaaggggtggccttgctgacggagccagaccctgctttccagagttgcaagcaccacgggtgggggcgtcccttcgttctgctgactgacccccagccgctaccagagcccactctgcagtgccatcaacatcttctttccaaagccagcaagtcatttggtttccctgacaatagggtccccaaaagtggccagctgtgtgcatttgtacacagaggatctctcggtgtgtgtttttttgacctctgcttgatggtgtggccgaaaatcctttctctgtgccctgggagcgctgaggaaatgcagccagagtggcccccagcagagcatcctagagggacaggctgggaggggaaggtgggagtgactccgacttgtctccacataactcctgttcattaccctgggtggccccccgagtggggggtgtccatgcctccccctggagcatttctcagtgtctgctgatggagaaacctcagatgtctcaggaattgacgtccatggttcacaaagcttgtcacagacactagcacctcacagacacacatacaggggtgttctttagaagttgtgttatggaaatctcagctgtggcatagagcagagagaatgctgggaggcccccatgtgcccaccacacagctgtagctgttgtcaacatttgaggggtgtcttaatggtaaattatggtgggcctttacccctgatccatgcccatgagctgaagtggtctggcgtgttgtgcacacgcacactcaagttcttgacacccacctgtgttttgtgtccctgtttcaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccat

SEQ ID NO: 7998 - DNA, 1018 bp, mus musculus
ttgcttgtatccaaaatatagacacagtgctgggtgctgattttgtcctttccttttttccaattctctttttctcaattgtgtccaagatacacagagccagagaatctcacaggtgtcttagaattcctgctcctgggactcccagatgatccagaactgcagcccgtcctctttgggctgttcctgtccatgtacctggtcatggtgctggggaacctgctcatcattctggccgtcagctctgactcccatctccacagccccatgtacttcttcctctccaacctgtccttggctgacatcggttttgcctctactactgtccccaagatgattgtggacatccaggctcatagtagactcatctcttacgtgggctgcctgactcagatgtcttttttgatctttttcgcatgtatggaaagtctgctcctgattgtgatggcctatgaccggttcgtggccatctgtcaccccctgcactaccaagtcatcatgagcccacgactctgtggcttcttagttttggtgtctttttttcttagccttttggactctcagctgcacaatttgattgtgttacaacttacctgcttcaacgatgtggaaatctctaatttttttctgtgacccttcttaacttctcaagctggcctgttctgacacctccattaataacatggttgtatattttattggtgccatatttggttttctccctctcttagggatccttttctcttactataaaattgtttcctccattctgagagttctctcttcaggtgggaagtataaagccttctccacctgcagctctcacctgtcagttgtttgcttactttatggaacagcccttggagggtacctcagttcagctgtgtccctttcctccaggaagggtgcagtggcctcagtaatgtacatggtggtcacccccatgctgaaccccttcatctacagcctgagaaacagggacattcaaagtgccctgcagaggctgcacggcagaata

SEQ ID NO: 7999 - DNA, 656 bp, mus musculus
gcagttctcctaccactctggcccccaaggaagcggatggggcacttctcaagcatatcttggaggcttggctgggaagtaagaaacacccccaactccgccccattggatttatagggattcttgccccacacctgtttagatattaactcagccactacaagtcaaggcaaacaggccagggccagggcagacaagaggacagacaagaggacagacatctgcagcctgtggcctcctgtcaccctcccacccaccatggaaatgccctggcccctagggtggattctgcttcttttgggaagccccctcatccacgctgagcctctgtgagtctggggaatggagggggctcagccggcttcctgcacatctgatgtctgcgtgattccagcttatgactcgtgttcggtgtcattttccctactcaagtcccttaatgcccttgtgttagtctactggcaggtacatcctggtgaccccccgagttctgagggttggcagtccggagagcattcacattcaggcccactcagactccagacagcccctcacaaggaccctcaaggtgaacctcacagtgtgggacttccccatgaggaagacagtgttggcaaggagccagctcattctctcaccaggaaacaactttatgg

SEQ ID NO: 8000 - DNA, 1031 bp, mus musculus
ctgggatcctcccccgccctccagcctcacagctattctctgtcctcccaccagcttcatgtactggactgactggggaactcccgccaagatcaagaaagggggcctgaatggtgtggacatctactcgctggtgactgaaaacattcagtggcccaatggcatcaccctaggtatgttcgcaggacagccgtcccagccagggccgggcacaggctggaggacagacgggggttgccaggtggctctgggacaagcccaagctgctccctgaaggtttccctctttcttttctttgttttttctttttttgagatgaggtcttggtctgtcacccaggctggagtgcactggcgcaatcgtagctcactgcagcctccacctcccaggctcaagtgatcctcctgcctcaccctcctgagtagctgagattacagacacgtgccaccacggcagactaattttattttatttttgggaagagacaaagtcttgttatgttggcctggctggtctcaaactcagggtgcaagcgatcctcccgcctcagccttccaaactgctgggattacaggcgtgggccaccgtacccagcctccttgaagtttttctgacctgcaactcccctacctgcccattggagagggcgtcacaggggaggggttcaggctcacatgtggttggagctgcctctccaggtgcttttctgctaggtccctggcagggggtcttcctgcccggagcagcgtggccaggccctcaggaccctctgggactggcatcagcacgtgacctctccttatccacttgtgtgtctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggtgtggcttacgtacgagatgcaagcacttaggtggcggatagacacagactatagatcactcaagccaaga

SEQ ID NO: 8001 - DNA, 1140 bp, mus musculus
aaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcat

SEQ ID NO: 8002 - DNA, 134 bp, mus musculus
cggaggtgttcagctgcttcaagatgaagctgaacatctccttcccagccactggctgccagaaactcattgaagtggacgatgaacgcaaactttgtactttttatgagaagcgtatggccacagaagttgct

SEQ ID NO: 8003 - DNA, 1173 bp, mus musculus
ggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaag

SEQ ID NO: 8004 - DNA, 1077 bp, mus musculus
aagatggcaaagccattgggagagctgagagggccaagaaaaaagactaaggcccaggctctggccaagttggaagaatggagagggagcagcggccccagggggcaggcgcccaggtcagacagccaagtggggctcaggtcgtggctggcactggctgaagatacccctgggagctggcccacaggggaaggggcagagctagtaaaagggagcccccgatccccaggacacaagcagatcctggcaaagagagaaaagcaccccccaagaagaccctagatgggaagaactagtgccgtgtaacatcctatggatgcctaagacggccaaacaccttctgtgccttggcagttgtatgggtgcccaagaggtcttatcaaggcagctctccccttagcgcaaccgcgtctacagaaactcggagggccctatctgtccctcctccacacccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatggtgaggctgagtcctgttactatagcaacttcctaggcacactctgccccttaagtcagggaggggctgcagcggggtctggggcacaggcgaagagaagaaggatgtgaacccctggctggccctggaaacgcctcctgtacagccccgggctgtgcggcctggggaagagagaggggatcggtggcccagttcagacaagggaggatggtccacccggcagggggccagctcagagaggggtggtggagtggtccatcccagtgttggggttcagctcagactgtaggatgagccatcccagtgttggggtccagctcagaatgggggtcgttccagccagtgttggggtccagctcagagttgtgtcatttaggtaagcccagagcagggaatccaggctccactggaggaatcagccagcctcgagtagggggccca

SEQ ID NO: 8005 - DNA, 1077 bp, mus musculus; identical to SEQ ID NO: 8004

SEQ ID NO: 8006 - DNA, 3633 bp, mus musculus
gctggggggcccggctgaactcccgccttgatccctccttcccaccaggcatccggtcttgggatgtcgatcctggcgtctgcaaccttgatgaacagctcaaggtctttgtgtcccgacactctgccaccttctccagcattgtgaaaggtgaggctggggtccccctgactgctccctacctcttgttatttggggaagtgccagccgtgtgccaggcatggggggtgggatgcagctataaataacaacagtaataatacagttgagacctttcaaatgcaagccgtgacccagtgataaccccctcagtcctcagcaacccacagtgcaggaactggtgtttttgtccctgattgacagatgaggaaattggcattgaagggggaagaggcagggagatctctgaggagggggttttttgatgagaaactgctatgactggtgtgtccagtggaagggaagggccccagtcaagacccagcagtggacagaacatctagaatgaaccgggcgcggtggcttacgcctctgatctcagcactttgggaggccgcagcgggcggatcacttgaggtcaggagttggagactagcctggccaacgtggaggaaccctgtctctactaagaatacaaaaataacggcatggtggcaggcgcctctaatcccagctactcgggaggctgaggtgggaggatcacatgaacccaggaggcagaggttacagtggggctgagactgcgccactgcactcctgcctgagtgacagagtgggagggactctgtctcagaacaaacaaacaaacaaaaaacatctggaaggtggaggggcactgagcaggccctggaagatggagtgtgggccccttgcaggaagggactgatactggttcacagccacaggcctgggtatacagtaggcagggaactgaaaaggagtgagatcaagaagggcccaactcagcacgaggctcccttctagggtgacccagggtgagcagagcagcaggcgggcaggcagggcttgggtgttgcctgcagccgcccccggctcctgatggtctcttgagtcacctcccggctgctgctggagaggaaggaagtgtctgtagtctcattgtcccagttggtccttgtggcttcctgacacttcatggggcagaaagtggagctggaaatcctgtctgctgtgtgtgaacttcgtggccacttcccttctttatgccttgatttccccacctgaatggggcaatatccctgtgtggcaaaaagcgtgctaaggctgggtggggtggctctcgcctgtaatcccaacactttgggaggtcaaagtgggaggattttttgaggtcaggagttcaaaaccagctggggcaacatggtgaaaccctgtccctactgaaaatgcaaaaatgagctggacctggtggtgcacacctgtagtcccagctactcaggagcccgaggagggaggatcgcttttacccaggaggcagaggctgcagtgagctaagattgtgccactgcacttcagcctgggcaacagagcgagaccctgtctcaaaaaaataaacttaggcctgacatggtggctcacacctataatcccagcactttggaaggctgaggtgggtggatcacctgaggtcaggagttcgagaccagcctgaccagtatggtgacaccccatctctactaaaaatacaaaaattagctggttgtggtggcaagcgcctataaccccagctacttgggagactgaggttggagaattgcttgaactcaggaggcagaggttgcagtgagctgagatcgtgccactacacttcagcctgggcaatagagggagattccatctcaaaaaagagagagagagagagggagggagggagggagggggagagggagggagagagagagagaaaggaaagagaaagctaaatgtgataagggcgagagagagagaaagggaaaagaaggaaagaaaggaaagaaagttaaatgtgataagggctggcaacactggagggtctctgcctctcaagactcagccttgttcacagttcagtcctgcctcaggggccttggctggtgctgtaccctggtccgggttggccctcaccggcccccaccccggctctggctccttgccacccccctctcacagtactgatgtttaaaacacatacgggccctgggggacagagcagggtcaggatcccagaaacagccctacttcagccccggcccttatgctgccccacccctagctgagtcctgcctcaggacctttgctccggatgtaccctcgtccacgttcgccctcattggccctcctcgagctctggctctctgtctgaaaaataaatgtggccggatgggtgcagtgggtcaagtctgtaatcccagcactttgggaggccgaggcaggcggatcacctgaggtcaggagtttgagaccagcctgacccacatgttaaaaccccgtctctactaaaaattgaaaaaattaatggggcgtggtggcgtgtgcctgtaatcccagctactcgggaggctgaggcaggagaattgcttgaacccaggaggcggaggttgcagtgagcccaggttgcactgttgcacgccagcctgggcaacaagagcaaaactccgtctcaaaaaaaaagaaaagaaaaaggccgggcgcggtggctcacgcctgtaatcccagcactttgggaggccgaggcaggcggatcacgaggtcaggatatggagactatcctggcttacacggtgaaaccctgtctctactaaaaatacaaaaacttagccgggtgtggtggcgggcacctgtagtcctggctactcgggaggctgaggcaggagaatggcgtgaacccgggaggaggagcggagcttgcagtgagcagagattgcaccactgccctccagcctgggcgacagagcgagactccgtctcacaaaaaaaagaagaaaatggtggcatcactcccaggggtgacagctgcaaaccaggccctgcgcacgatggggccctctggttactgcctctcttaggccagctggggtggtttgagtttctctttcttgcctggtcctgacctgcagctctgccgtgcgcctgttaatctccatatgatccctgggtgggttcccagaggggttcatgttccctgagggtcacacggggaggcaggatttgactccgggacggcctgattcccccacaggccagcggagcctgcaccaccgtggagacaacctggagaccctggtcctcctgaacccatcagacaagtccctgtatgatgaggtagggaatggctgacgtcctggagggggcgggctgctgggacccgtgccttctctgtcttcctgtctcgtgtccttgtcttcatgctgccccagatcctctcaagacacccggcaccacacttcttcgcccacgaagccttccctgtggcttcagcctccgcttcttccctcctctggggtgggagcagaaaagcctggactttgggagggaggggagggtaagcactcccagctcagggcccaggacagcgtgggtctggaggtgggaaggccagagcagacaggttttcctcctgtgggttccctccgg

SEQ ID NO: 8007 - DNA, 1037 bp, mus musculus
ggttcactgcctcaacctcccaaccccacgcctgagcttccctgactgcccgtccttgctctcagtttgttccgatacaagcacccgtctgaggaggagcttcgggccctggcggggaagccgaggcccagaggcaggaaagagcggtgagtgacctgggccccagccccagccttgggagggtggctcctccccaggaacggcctcacccctgctcagggggctctgggctcagggacacaggaccggcccacccatacttccaggcgctgatctgggcacaggtgaaccgggagaccctagtccaaggagatggtcactgtcaagttagcatctgtttcctggcagtttgctctagccagtcctgtgggtgggtggggggatccccatatcccagtgtgcagaggagccaaggttgtggaaagagatggtctccaggccagctgctctgagctctgagggtggctggcctcagtggaatgcgtgctcaccgtccctcttgcttgtcaccatcctcccaggtgggccaatggccttagtgaggagaagccactgtctgtgccccgagatgccccgttccagctggagacctgccccctcacgaccgtggatgccctgggtaatagcccagtcccatccctaaactctactccctcagccctgaaggtctccacaccctcatgggggtggggaggatttgaaggaagaatgttctattaggaggggagcgagctgggccccagggctgagcagagtgccccccacagtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatgtatccttcctctctgctccctgccagtggggcgggtgggagcaggacctgagcttccctggctcccctaaactggtgtggcagttttcacctgctgtgccacaaacttcccc

SEQ ID NO: 8008 - DNA, 395 bp, mus musculus
atgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaa

SEQ ID NO: 8009 - DNA, 1491 bp, mus musculus
taaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctg

SEQ ID NO: 8010 - DNA, 1009 bp, mus musculus
actttgagatggacaattttctttaaagttccctggtgagtggtcagtcatgagactgagtggtttatttctagttcacaattacaaggaacattggccatttgagatataagctttcagtgtggggaaagggaaggggaaggaagagatttctactggactcctacctttggacagactctagacttactatgtgctctacagagccacaaaatccaaaactcaaggttactcaatttagcaaataccctcaaactgaaagctggtttaaatgctcttcttgcttctgggctcctggttttacttagtttttgacctctgactattcccaatgaatgcacggttcaatgatgcattttccaatgagttatatacccagcgttttaacagaaagatttaccggagtccctagtctattttttctatcagaattgaaattttcatctactctttatataaaattgtacttctaaggttcacatttgctatggtttgaattcttgtccccttcaaaactcatagtgaaatttagctgccactgtaacgtattaagaggtggaatatttaagaggtgttttcatgaacttaatgcctctctcatcctctctttgcctttccactatgtgatgttttctgccatgtgaggatgtagcaagaaggcccttaccagaggccagccccttgattttagacattccaaccttcactgtgatattctgttaacagcagcacaaaaaaattgactaaaaaacatttaattaagttattctgtttaaaatctgtgtgggctccacattgccctaagggaaacaccgcatcctttgcatggcttaaaagccgcctccgtcttgcctctgcagatctctcgaggctttgttcttatcagtcgtctcccatgaagcttttttgctgaagctggattaaactgcttgcaatcatcagagaaccccacatcctcttcctctctaggtattcaaatgctatttccaccccttctttttttctctct

SEQ ID NO: 8011 - DNA, 938 bp, mus musculus
aagaatgatgcgtagatgggtagatgggttgatggttgggagaatgaatgggtgagtagaaggaagatgagtggatgggtagataggtagatggatgggagaatgaatgggtgggtggagggatgatgagtggatggatagatgggtgaatggatgggagaatgaatggatggatggatggattgatggatgagtagattgggaatgagtggaaaaataaatagctgacgcataggtggaaagaagatataagtgggtggatgggtgaatggagagtagaaagtaggagaaatgggtaagtaggtaaaacatggatggaaagatgggtagatttgggatacaagttgaggcttgcaggatgggtgggattgggattgcaggcatgcctaaggttggagtttccagcaactgaatactgcacactcatgtcttccaggaaggaggccataggaaaaaagtctccaagtggtggtaggtcccagaattccatgccattccatgcttctgcctgcagtccctaggccactgaacctagacagaggggaagggcagagtgagtggacacagccaatcccagcctgcttccgactcccctaatccctcagcctttagggacaggagcagcggacctcctccctctgctgggcactgggtactctggtggatgcagcctggcccagatttgctgattcttgtccacgtacaaattaatgtagatatgttttttcaggcatttaagaaatcccatctccaggtgggcagataaataactctatttacattaaagactaatgtaacaaaaatacaccaggcaataattcataatgcattctattctacagagtcatattttaatgtgtgacatatcccaggcagctcctctgtgctaatttcatttaatgagcacatgttatagaattttcagagcactatccctg

SEQ ID NO: 8012 - DNA, 635 bp, mus musculus
tgtttaggttgggggctggttgtcaccatggcccatcctgatggaactcagtagtcaaggggagaatgtacgccaggcggggaaaccagagatgcccagcaccccccagaaagtcagatttccttaagcccagtctgggatgtgtcacctggctgctctggcaaggtaatgtggtttgatagctgttgagctattgttgtaatgtcgtaacgtatttcaatggccatttttctttttctttttcttttaagatggagactagctttgtcacccaggctggagtgcagtggcagaatctcagcaatagctgtttttctgttcttgagttgggagagacttagctctgtgaggctcaggagaagaggcctggttctaagaaaggttggccaggccttttcttccacagccattttgcttttaaattcagccttccgggcatgtaagaacaaccataagagcttcctaatctgtcagggaaggaaaggaccgctgcagtggctggaaagtggtgcacaccgccatgcgggtcatcggccttcgcatattgtttctgctgagtagtcctgagtacagagcccagaaacctggtttgagtcctcactgtccacaaactcattgagtggtctgggactgac

SEQ ID NO: 8013 - DNA, 1771 bp, mus musculus
ataatcagggaaggcttagaaagactgctcaggatggatagggtaggggagggttggctacaaagacgaggtaccaggcagtagtctgggcatgagagggtgaggcctcatcctgttacattacagagcatttgctttgctcttcattccatgggtgccattccaggtgtgtgctgaagacttttgggaaggtcttcaacaggtggtttctggggccacctgagggctggtacataaagcctacatgatttgcctttcctggcctgtgcaggccgtggaatcccgtgctgagcctggtccaggtgggatgctaagatacccgccctgccgtggcatgtagcataaagccctgtgaagcctggctgtggaccctgaggagcctagggacatggggagggggacacagcttgcaggacagcagagtatgggcactcaggtcaaagcgtgggcttggcaaggcctccctttgctcctgatagagagggggttagccctcattattcttaaggtgcccaaagctctgatagcctgtagttcaataacttaaaattgaaaatgtaggttaaaatactgttataaacacctacagccaccccacagtgaagacagccactacaccttgaacccagccctgtctggggtcctagctcccctctcccagaagacaggtgtaattatgctgtttttccacaagaaactgaggggcagggggcttactgtcttgtctgaggttacccagctgggtcctgtcagagcagggacatattcttagccacccatgatctcaagccaccccccaggcattaggagagccccttgcaggtgcctctgagttcagggcagacacatggtaggtgacatgtctctttaggtcttgcacctacaccctggttttacacctgttcccagatgtggagatggcctggctggaagtccagcggcccgaggagtgggtgcctctgttttctcaccccatccttccaggggtctgtgctccagaaggcgtaggccatgtgcgtttgaacccagccctcacggaggttgctggcaatgtgtcttgggcagaccatttgcgcctggctgctggagcggggctgggcattccttctggagggggagatgagtttcaatgacctctgaccattgtctttggagggtttaccttgtaatggagtgttgagtcaacattcagaattaagagcagaaaggtaacattttaaggcatttcatcaattcttctgagacgcccacacatcttgttttccctcttcaccacttaggcagcaatttcttttcttgtttctaacagctacctatagaaaacacttgaatgcagatcatatcttgatggtatttactaatataaatatttgctttctagaagcaatgttacgcaaaatgcctacgctgcaggctaagcgaccgagtgcttgaggtaagaaatgccacctctgtggactggagttggtgtctagccgtctccacagtggcacgcaggatactggcagaacggccaagtgtcggcacatccggcctgccctttccaaggtccttgtgatcacattttttaaaatgataaaaccatcttggccagtttcccccaggaccccttgagctgatggagccctctcccaacactgcatgaggttcagttgcatatttgcccagaactgtgctgtgcccagaactgtgtatgacagccttcaaggagcttacaatgcatgaagatggggtgatatcaaacctcatatcagttacatttatatttaac

SEQ ID NO: 8014 - DNA, 1612 bp, mus musculus
tcacttaaacaaatctactttatctattactctttaaattgacattccattatctcaactttgaggctctagtccacctattcattgtttccaaggatactcctttctaatctgtgctttctggtctgcttggtaatttttgattgagagttcattgccattgtcagtgtgtttttctttttttctcatgagaagcccaggtggacagtgttatgaagttattctcacagaggttttatgtccttggcttcttccattgtctagggccatcactagctcaaggcaaatcttatattaattttggagggcttagagttttctggatcctccagagattgaaaatttaaactccaaacagtcttaggctagggttttgaattctcaagcaagcatttagacccaaaccaatgagtaagctcctgtctcctttccccatgatggtccatagtttttgttttttttttttcacagagccttccttttaactgagagtgtagctttttaaggatcccgtcttcaagtagggattatggtccatctcctctccataccagcctaaggcctcatctttagtctctacatagcctttaaaactccagccctggggattgccccaaggaatactattatgggttgaattatgtccccttaaaattaaatatgtttcagtcctaaccccagtacctcaacaacataagatcaaaatgtgaccttatatggaaacagggtcttgccaaaggaaatcaagttgaaataagatcattagggtgggccttaatccaatatgactgatgtccttatagaaagaaaaaatttgggcacagagatagacatgcacagagggaggagaacttgaaaacacacagggagagtgtcatatgaagacagaggatggagtgatgtgtttacaagccgaagaatgccgaggctaggagaagctaggagacagttgaggcacggttctttccttgcaccttcagagggagcctggccctgcggactccttgtttcccacctcctgtcctctggacctgtgaggtgatacatttttgttgttttaagccccctggcatgtagtactttgctactgcagccctaagagatgaatacagaaaacaccctccccagttcctgcccctcactctgaaggcagccctgacatcagcacctcacaactcttacgtttagtttcctcttcacttccaacccacgaagattccttttttccaaccacagctttgcattgtcaatatttttggatagttgcatgctatgcagtgtttctctgcacttgtagtgggagaggtttcatgttatcttagccccccctcagctcacattatgaccttttgggcattaagaacccaagaaaaaatgagccaggcatttctagaataaaaaggcaatttcttcaagcacgccgccctctagggccatgctgagcctcgccaagggcagggcctggggcatgttgtgttgtgttggaagtgccatgaacacgaggctgacagaggccaggcaagtgacagaaatatgcaaagctggccaggtatataacaggccaactcttttgaacccctcaggcttcatgacatagcttttatttttctac

SEQ ID NO: 8015 - DNA, 883 bp, mus musculus
tttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgatttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggactt

SEQ ID NO: 8016 - DNA, 1004 bp, mus musculus
cccagtggggcaaaaaggagggcaaagcaaactggaagagacttctactctattgacagggctcttcagatccaacatcaagctagacatgcccttgctggccactctacaggttgctgtcccactgctgagtgacacaggccatgctacatttgcaaggaaaaaaatgagacaggaaacacaggtataggtcacttagggatgagcaggcatccacagcttcaaaactcttcatggaaggggtaatccttgtgggaggcacagctcaccaaggcacagactctccaattcctgttgtagctgagtaaggcggtcatatcctggctgttcagttcaaagtcaaaaaccttaaagttgtcagcaatgagttctggtgtcacagacttggggatcacacccaaattcctctgcatggggaaccggatcaggacctgggctgtagttttattgtgcttggctgcaatcgccttgatcctgggatccctcaggagggaagggtcctcggggttgacccagggcctgctgggagtgccaacggggctataggcggtcaccacgatgcctttggactggcagtactggattaacttctcctgagtgaggtaagggtggcactcaatctggttaaccacaggcttatactttaagccaggtttgtttaagagcctctccacttggaggtggttgaagttggagatgccaatagctttcatcagccattcatccaccagctcttccatggctgcccatgtgtccagaatgttggtgtcactgggaaccacattacccaactcattcaatggaaaaattccctcccaggcttaaagccagtcggccaatgaataaggtagaggtccaggtagtccagcttcaggctgctgagggtcttctggcaggctcccttcaccaggcccttcccatggtatgtgcaccacagcttactaacgatgaagagctcctcacgctttaccacctgctccctgagcttctcctgaatggccacc

SEQ ID NO: 8017 - DNA, 2210 bp, mus musculus
tggacacatcctttccccatgttgcaccttggtttccccatctagggtagggacggggaatggttgagagctgtaaagtctgtagctggatatgtgagtccctgtgagcctcagtttccccctctgcacaacaggaatgatagttctgcctgcacagggttttttgcaaagacccgtgaggtcacacgtgcagagcctggcatgtgtgtggtgctgctgcagtgaagtttgggtttttccattggtggtgccatagaagagctaggctctggggtcaagccctggggtcaagcccgggctggaaccctgtccctaattcttagacgttgaaatcttctgcaaagtccctgatgggggctaagaagagaatattgctttacagggctgctgttagatgctaaggaaaccatttgagtgacacacagagcacacccagcccatagtgaatagtcagagttcagtaaacattcagccaccatagagagtgttgtaagcatggcagggcatggtggctcacgcctgtaatcccagcactttgggaggccaaggcgggtggatcacctgaggtcaggagttcgagaccagcctggccaacctggtgaaaccccgtctctactaaaagtacaaaaattagctgggtgtggtggcatgtgcctgtagtcccagctactcaagaggctgaggcaggagaatcacttgaacccgggaggcggaggttgcagcgagctgagattgcaccactgcactccaacctgggtgtcagagtgacactccatctcaaaaaaaaaaagaaaaaaaaaaagagtgtgggagcaccctcctcttccagttgatcaggcacgtgctatttagactgaaagaggacactctgcagccagctgatctggttctcactccattatgtcctagcctgtgatggagccataggagaatgactcaacccctccatgcctcagtttccccatctgtaaagggtcttgtcccctcaaagggttattggaaggttaaataagttagcacatggaagccgtcagcacaatgcccagcgcataatgagcaccttatgtttgctcttcttgttgctgcagcggttcccaggggctccctgatctcagggcaggttgacatggggggatctgggcaggggaggggggggccagcccaggagggaatgcctgaggtgcccaggcctagaggtcaccccaaggagcctgtaatcagctgtggtcgggcggttctgctccaccccaccgccctccctgggtatatcaggactggtccgggcccaggctctgttgggtgggagcacaggcaccgggcaccatggggaaggccgtgagtggggcccaggggtccggggtgcagtggggacaggggttgcagtggaatctgagttctccctccctccatcctgtccattcccaggagaactatgagctctactcggtggagctgggtcctggccctggcggggacatggctgccaagatgagcaagaagaagaaggcgggtggcgggggtggcaagaggaaggagaagctggagaacatgaagaaggagatggagattgtgagctctgactggggaggggcgggagctggagggtaggctgggaaccaggcagtgggcggggagggggccaggagagcccagagcaagcaccctgccccaccccaccacacagaacgaccaccagctgtcagtggcggagctggaacagaaataccagaccagtgccaccaaggtgagctggagactgggagcgtacagaaaggggaggaggagagagggagggagagggagatggaaggagggagatggagagagggagagagagggagagatgaagagaggaagatatggagaaatagagagagggagggaggcagaaaaggaaagagggagggagggagagaggaaaggatggagggaggggaggagagagggagggagatggagagagggagagagagggagagggagagaagggagaaagcattagagagaaagggtgacacacagagacggagagaggagtagctgaaaagagacagcaagacagagaaggcagagacaaataaggagagagcagcaggagagagacacatagaaaggggagcgaggagagagagacaaagggagagatgaaggagggagggagagatggggtgggggcaggaaccaagagacaaagagatgagaaggagcag

SEQ ID NO: 8018 - DNA, 1003 bp, mus musculus
agagagcacagcaacccaagcccctcccaggacacagatggcacaaaggccaccaagatggcccattccatgaggagcatacagaacggacagccccccaccagcaccccggcttcctcagggtccaaagccttccaccgactctccaggagaaggtccaaagacgtggagttccaggacgggtggccccggtcccccggcagggccttcctcccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcc

SEQ ID NO: 8019 - DNA, 844 bp, mus musculus
tttccccatctctgtctttctcccggctcacttttctctctatgtctatagcctccgcccctaactccccccaccccacaatcagagaacaggaggaggcgcccaggtcagggactgggctggacaggggcagagggtgcccccgcactgttcccatgttctcagctcccccaccctgtctcaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataacactgtgtggctgtttttcctccccccgggttaccatgggcttccccgagctccccccacaacctccctctctcctcctgtggcctctgctcatgtccctgtcccagcactgcagctgggcctgccagatggagaatcactcctcccgggccagaaagcatgagaacgggccctgctgagcccacgcccttgggatttatatcctagaccttgccttcccttgaactccccaccccacccccatccccagtcccagcaagcagggcccctatatgcaggctcctgcaggaatctgggtcaaggggcatgctcatgaccaaaggtgaccgatattgactcagtacaggtgatcacacagcaaacaaatcattcagccactccatgaaatctgcgctgtgcttataatggcccttggtactgaggctgcaaagatgagaggaagatggtctc

SEQ ID NO: 8020 - DNA, 1093 bp, mus musculus
gtgtgcctctcgatatgtaacttgacctctctgatctcgttttcttcacctacaaaatgtggctaatggtagtactagcatctaggtcaccgggttgatataaagattaaataagttggtttttgtaaaggtcttagtgctagtgatgtggtgagtgttacaaacagtttattattattggtcctataatttgggtccatttttaggtagctattcctccatggaggttaaaggtggccccttaaagcttcagactcaagtcacctactagtctgagtcacgccaagagaatgaagacagcatctttcccattaattctaacacaaatcccagagtaaactctgatcggcccaccgtgggtcacatggccagacctgaggcatgagacccacagtctcatgactgtgaccaaagacagacatgctctgataggccaggtgtgagtgacgaaaggccagagaatgagatcccaaggacggaggggctggtgggcataaggagggcaatcggagttggcttgatgggctgccagacaggagggagagggcctgaacatgaacccgaccttgctctgcagatggccaggtgtcctttgagatgctgcccaggcagtggtctgtgtgcgagcagataggaggtactcattaccccgatgggtctgcggtgggaggctgggggaactgaggatgcagaagagcaggggagggtggcaggggtcatgggaaagaatgggcagtgtcttagggaggggtgagttatggggaggggtacagctggcacaggaccaaggctattgagccctggggcggctctggactgcccctttccctctcagttaccacctgctccataatttggtctgaatacatcgcgggtgagtatactctactgctgctggtggagagtggatatggtaatgcaagtaaacgtttccaggtggtcagctacaacacaggtaatgagggtgatgcaaggggctgggcacaaaggggcaggatcccagactgtggactgcatgcccatcctgagggatctgtgcccagcagacagagggagggcaacattacctgtgtcactcctggttgaggagtag

SEQ ID NO: 8021 - DNA, 831 bp, mus musculus
ctagctatcttctcatgtatccattgctccaaatagtgcaaacatccaggtcttcatctctttcagcacctgcctctttgatttagctccatgaacttatcttgtttggggtctccatcctccatcctggtaacacccagctattctggggctgtggcctcacctctgtgtttgctgggcatcccccaccaggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatggtgagggatgtagtatggaaaccaggcttcttggggcaaaggcacctggatcctcatgggatgagggcagtcagggtgggtgtttagtctgcaagcggaggtgctaaatgtctgtgtcttgcagttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgcatgtcattgtgtctgtctcatgccttctcatccctgactttcctcctgcacagcaggtatcaggtgcctg

SEQ ID NO: 8022 - DNA, 300 bp, mus musculus
caggcgggtcatgggggacagtcagttagagacccaggttccttctggcttgtgattctgccctcctctaggctccttggagtcctctctgttcagccagtgtgaaggattatgagggagatgggtcaggctgcaagaggtgtttctcttccacctacatcccattggccagaattggtcacatggccccacctaactataaaggatgctgggaagtatagcctaattatgtattgtatcagttaactttagcagtagaacagatcacccacaacttaggagcttaaaacaaccaccacc

SEQ ID NO: 8023 - DNA, 250 bp, mus musculus
ttgtcacagaataatttttctgagcctcaagcatgaagctaagagacctttttgaagggccaggccagtgtcttacctgccccaggtccttgtcactttctgccatcctggtgtccccaccaggcaccccaggccttgctgtgcaaaggaggcacacagctgagaagaggcaggttctagctctgtcatttcctttctgagtgaccttggacatgtccttttctgaacctcagtttccccacctgtaaga

SEQ ID NO: 8024 - DNA, 1498 bp, mus musculus
ctcttagtttctgttacctttgtggcttgcctgggctcagccggacagttcttttgctggttgctgcttggcaggctctcatccaggtgcaggtggaggtggctgggctggagtcatctggaactggcactgggactggggagttggttccctctcagcgtagcctctgggcctctcttctccacgtggtctttcctgcagggtagctgaatatctcacatggctgctcaggactccccaacagccagattttcatgagggaagaagcagaagctgcaggttatttaagggcaaggcctggaatcttccagcgtcatttccaccacactattggtcaaagcagctccaggcacagaccacagtgggtgtgggaaagaactgcacagggtgtgatacgaaggggtccctgatggcacagtctgccacagagtaggcactcttggcttcggatcttggcactgctgcttattagccatgtgactttgagcaggcagcttgacctctatgagcctccatttccatatttatcaaatgggatactaatagaacttatctcccaggattcttgtgaggatgcagcaggatagtggataggcgagccctggcccgggacatgcccatctggttgctactacaggctacagggggtatacatggaatccgttttttttttcttttttttttttttttttgagacagagtcttgctctgtcgcccaggctggagtgcagtggcacgattttggctcattgcaagctccgcctcccgggttcacgccattctcctgcctctcagcctcccgagtagctgggactacaggcgcccgccaccacgcccagctaatattttttgtatttttagtagagacggggtttcaccatgttagccaggatggtctcgatctcctgacctcgtgatccgcccgcctcagcctcccaaagtgctgggattacaggcgtgagccactgcgcccagccccctttgttttttttgagatggagtctaactttgttgcccaggcttttgccttcctgagtagctgggattacaggcgcctgccaccacgcccagctaatttttgtatttttagtagagacggggtttcaccatgttggtcaggctggtctccaactcctgacctcaagtgatccgcccgctgtggcctcccaaagtgttgggattacaggcgtgagccaccgcacccagccggaatcccttcttgtcattactgcccaagtgccaaaacctctgcttctagataaagacttcgtgcactcagatccttgccctgctgtttacgtggtgtgtgtcctgcatgagtccctctgcctttctgtaccgaatagcacttaacctcatagttctgatgttccctcagcaccattcagtaaacagtgtttactgtttactgtttgcagcgcggcctcgaaccaggctgcctgcttatctgtccccgctctgccactttctgtgtgaccccagggagagttatttaacc

SEQ ID NO: 8025 - DNA, 1498 bp, mus musculus; identical to SEQ ID NO: 8024

SEQ ID NO: 8026 - DNA, 488 bp, mus musculus
gtactcagtaaatctttgaaatgacctgaactcaatccaggtgggaaccacaaggttggactctgatgaggcctcacaagttacatttccagcccaggcctctctcctaagctctaatctcctatattctcctgcacatctctccccgaatgacctgcaggctccatgcttttaatgcaccccaaactggactcatctttccttaagcctggttgtcttccaggtttgccatccagaggtgtgaggattcccatctgcagtcacggcacctggtactcaatgcctgggtgtcttagtttgtttgggttactatagccaactaccataaactgggtggcttataaacaatagaaatttatttctcacagttctagagtctagaaagtccaagatcaagggaccagcagattccatgtctgatgagggctcattttctgattcatagacaatgccttctcgctgtgtcctcacatggtagaaaggcaggg

SEQ ID NO: 8027 - DNA, 4276 bp, mus musculus
tcaccaccaagcacatgctacccacggttctgcgcatggctggggacccggttgccaatgtccgcttcaatgtggccaagtctctgcagaagatagggcccatcctggacaacaggtgaggtctggatactcccccacacactggcaggggcttcttgtgggcaccttaatctttgacctttgaaggtagagcccagggtcagaggcctggcagcgctccttgcttgctgtgtgaccttggctcccttcccttctcaaggtgtgttttctcaactgtaaaatgaacatcacagcatgaaatagaaagagggggtgatgggttggcagtcctgtatactagcaacaagtcattagaaaatgaaatcaccttatgttttatatgtaagtatgtgtataatttataattgcaccaaaaatatcaaatagccaggaataaattcaatgaaagatgtgtatgtaacacctctaatgtaaactgtaaaacactaatgtgagaaattaaagcagacctgaccaaggtgggcggatcagttgaggtcaggagttcacgaccagcctggccaacatggcgaaaccccgtctctagtaaaaatacaaaaaattagccggtgcggtagcactcacctgtaatcctagctatttgggaggctgaaggcaagagaattgcttgaatccaggaggtggaggttgcagtgagctgagatcatgccactgcactccagcctgggcgatagagcgagactgtctcaaaaaaaattaaagcagacctacataatattcacggatgggacagttccctgaactcatctttagattcagtataagcccaataatcttaacaggttctttagtggaaaattgacacttctaatgaacaaagttgtctgatttacactaccagagacgaagacttatgacaccacaataattaaaatagatgtgaacacaagcatatttaaatcgcccaatagaatggaatcaagggtacagaaacagtcccacatgtgtttaacagtaggcatctctgcagttcagtggagaaatgtatgttttttaaaaaacatagctgagtcaatttgatatccatttaggaataaaagaaggctcgcctcaatgcataaacaaattaatttgagatgacagaccagaaccagaaagattttaaaaataaaggacctagaagaaaatgtaggaaaatatcttcttgagttagcgtaggcacagatttgttaaacagcaaaccagaggaagtgatgggtaagttgaccttctgtaaaatgtaacgctgtttctcaaaagacagcattttgagagtaaaatgcaagccactgactggaggaagatgttttaatatatgtttctgagaaaggactcatccacaatacctgtctacaaatcaggcaagacaagaaagagatggggaaaaagacttgaataggcacttgaaaaaggatctccaaatagccagtaagcatatgacaagggtgttcagcatcattagccttcaggaaaatgcaaattaaatctcagtgacatatgactacacgcctcccagaacagccaacattaaaaaagactcagtggtgcaaatggtgaagacatagaagagctggaactctcatccattgcacgtggggctgtacatttagggtttgatcactctgaaaacgggagtggatctggagtggaatttggtgaagcttgttatacaaacagcctgtgaaacagcccttccactcctgggtctctatccaggagaaatgagtgctgtttctgtcagaagaatgttcatggtagctttattcatagtagccgtaaaaatggaaacaacctccatgtctgtccacagtagagtagataaattttagttcattcaaacagtggaaaactattcagcagtgacgaaacaaatgcctgctataagcagcaacaggtgactctcacagataccatgttgagtgaggagccaaaatcaagaaaacacaccatttatgtcaagttcagaaacaggcagaatgaaggaatcgagatgatggaagtaagaatagtggttatttggggagaacagggaactgtcaactgaaagtgtgggacccacaactgcagatttctctttctgtctgttccaggacacaacctcagctttagtttctctccgaagtccccctccgttttccaaaacaattgactcttggtgcaggcggatttccctgggccccatagatgagagtggatgcctcctctgggctcctggaggaccaggaacttccccttggggccacttaccactcccctcttacgtaccagtttggtctcttcctcctggcccgggtgcctcatggcagaaatcaagagtgatttagctctgtattcactcctaatacattgtaggcctcagtgaatatgtgtgaaatcaatgaaagatacccatttgctgggcctcagagacttgggggttctgagattctgttccactttcccagcctgctctgatctccctgtttggggccccagtccttgtttatcatacttctgacctttaagtaattggttggttggttggttttttgcagtttgtttggttttcctttgaggcagaatctcgctctgtcgcccagactggagtacagtggtgcgatctcggctcactgcaacctctgcctcctgggttcaggcagttcttgtgcctcagcctttcaagtagctgggattacaagtgtgcaccaccatgcttggctaatttttgtactttgagtagagatgggggttttcccatgttgtccaggctggtcttgaactcctggcctcaagtggtctgcccaccttggcgtcccaaagtgctaggattacaggcttgagcccccgtgctcggccttgagtttacctttttttttttttttttttttttgagacggagtttcgctcttgttgcccaggctggagtgcaatgatgcaatcttggctcaccacaacctccgcctcccaggttccagcaattctcctgcctcagcctcccaagtagctgggatcacaggcgtgcaccaccacgccctgctaattttgtgtttttagtagggacagggtttctccatgttggtttggccaggctggtctcaaactcccaacctcagatgatccacccaccttggcctcccaaaatgctgggattacagatgtgagccaccacgtccggcctgattttacttttaattgactcataattttatatatttatgggggtatagtagtgtttcaataatgtgtgcaaatgtgtaatgatcaaattaggataattagcatatctatcaccttaaatgtttactgtttctttgtgatgagaacattcaaaatcttctcttatagctgttttgaaatatgcaaaatgttattattaactatggtcacccgcctgtgcagtgatcagagatttctaattcctgtgtgtgccctggattcttgagactcctcccaccttgggtttggtgtatccgtgtctgtgtacactctcttgcccaagagccctgtgcccacctgttgccccagtccatcctggctcaccctctctctccctgtctcctttcgctttccagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaa

SEQ ID NO: 8028 - DNA, 683 bp, mus musculus
ttggatgcaaatttcttttgtatgcacacagggtaggcaggggtgtgtccattggaagcacctgcctcttgagtgtcttccaggtgatcaccatcaaccctaggaactccaggtgggcagagatgaaagtaaaagccccgacatacattggtctctccaatatcctgtgctgggccttccacatgctggtaaatgccatttttcctatttatacaactggcaaatggagcaacaacaacatcacaaagaaaggagatttgggatattgttctgccccacttagtgatgaagtcacaaagtcagtatatgcagcattgacatccttccatgatgttttgtgtctggggctcatgctctgggccagcagctccatcgttttggtcttgtacaggcacaaacagcaggtacaacacatctgtaggaacaatctctaccccaactcttctcctgggaacagagccatccaaagcatccttgcattggtgagcacctttgcattatgttacgccctttccttcatcacctacgtttatttagctctcttcgataattccagttggtggctagtgaacactgctgcactaatcattgcctgttttccaactattagcccttttgttctcatgtgccgtgaccccagcagatccaggctctgcagtatctgctgcagaagaaatagacga

SEQ ID NO: 8029 - DNA, 312 bp, mus musculus
gacccagacatggagctgcgggaagaagcctggtctccggggccgctggattctgaggaccagcagatggccagtcacgagaacccaggtgagcagccagaggccttcccagccgaccccgctgcctcccacctgaccctggcttcctttgcctctgggtgggaggaaaccccccttccctgttttcccctcttggggccctgggaccacccgaccctggcctcccctcccgccctgggccttgcactcctggctgtagagggagggctagtgttgtggctccaagtttcctttctgctggatgatcttggg

SEQ ID NO: 8030 - DNA, 6015 bp, mus musculus
ttatgtgtctaggactttgtgtttctaagcccgatgtgatctcctcgttggaacaaggaaaagagccttggacagtgaagcgaaagatgacaagagcctggtgcccaggtgagtgtgggagaaccaggtagggtgaggccactgctggtcatagttcagctgactcagacacgcaacatcttcagcagactcttcctaagcctcttgcttaggaatatctgttatttttactatttgggaatacagaaatttcaactacagtattatttccagaacagcaaattattaagacaaggaattagaattatagatttctttcagaggttttatcctaacaggaaatggttacagtttctaaagcattgggaatcttacaaggtttctttgttcaattcacacttcaaaggaaacgcttgcattgacaacaggacaagttactgacagttataaattaaagtgactcacatgggtcatcatatagcataagagaacaagaatgtgtgaaagtttccaatttaacatcatatgaaatcacatactttgagctagtttaatgagatagaactgttttttcttcctgcagatcattcatctcttcttgagactagttaattgtgaagacttacatttttaaggccaggatctggacttttattagttagcatcgtaataaaaaaaaaggaggtatgtagagatagagatgaaattttttctagatgaaatggacaaggagtgaaaaagagttgacttaaagctgaaataaggatcatatggcagttttcttctatagcctccactttctctttatattagacattttattttacatttaagtctttgtgagctcccttatctcttgatttttaattgctttttccagtcttctgctaaaaacataatgtgaactcttattcaacttttaggtgggaaaggtcttattgtggcctttaggactatggctacacaaatttaggaatgtagggttggttgaatattgctagtaatataagaaagctttcaaaatgatatgcttttcattttcttccataaaaataaatgactatatgcttttttgtggcttttaatttaacggttgcattttggaatttttcttcatactaacacatgataaaagataaatttaccttctttacgtctttcagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccggtaagtcacaagacaaatttcaggcaagaggaaggatccttcatgaggaaactcttcttgagggaagagaccatgactacaacaactataagagaagttttcatttgaatacaatgcttcttatagacagattatcccctcagaacagagagtgcctaatctccatacacataagaacagtggagggggaaattgagttgtaatgaattacaaacaaatctgtcaaggtcagaaatgtttgacttgtgatgaatgtaagaaagctttgagcagaggccaggcgcggtggctcacgcctgtaatcccagcactttgggaggccgaggcgggtggatcacaaggtcaggagatcgagaccatcctagctaacattgtgaaaccctgtctctactaaaaatacaaaaaattagccgggcgtgctggcgggcgcctgtagtcccagctactcaggaggctgaggcaggagaatggcatgaacccgggaggcggagcttgcagtgagccgagatcgcgccactgcactccagcctgggtgacagagcaagactccgtctcaaaaaaaaaaagctttgagcagaatatcaacccctccttttcatcaaagatttcatacaagagaaaaactctgtggacttgttgaataatttgtatgaatatgggaaagccttccgtctgttaaaaggttcatactgtgtgtaagttcatactgtgtgtaagtatgacaaactctccatagcagaaagtttctcctatttttctgtgtttttccccaaacatgtatgctataactaagccctgtcattatttgacctggtgtaccagaacttaagttgcagttcttggtatggagtgccttttttgcagtgtggacacagtccatcccactgagaccaggtgagttcacgaacatggtttgatttaaaaaacgtgcttttaccattgcagggcttggtgactatcaaaaacctggctgttgacttccgccagcagctacacccagctcagaagaatttctgtaagaatgggatatgggagaacaacagtgacctgggatcagcaggtaaggatgtccctctcccatatttgaatctatcgtcgggtacctccatttccaaacttcagttttgaattatggaggagggagggggtgtcttctgacatgctggcctgaattttgtggattcctaagataagaatttggcatttgtagaggtgaaagttggtgtctttgttaggcttgaagcgttatcttcttgtgtctttcagatcctactcacctgtttttctgtttctttcagcagtaacacttttctatcaacaaggaagtggttctcaattttaggatgccaagactattggccaaacctcatctcttttcactttttcaggacattgtgtggctaagccagatttagtctctttactagagcaagagaaggagccctggatggtgaagcgagagctgacaggaagcctgttctcaggtgagtgcaggagagcctggtgtggaaaatctactgcaagagagagcggagcttttaccaaaaaggctgcatcctcactaatatacagtaggaaactttacccagggtctctgggtctggaaagaaaattgaactctgggagttccaaataattctttcctcctcctttgcccccttctctccagtaactgccatttccctgaagttccttcttttcttggccactgggacgtgtatcatccacttgcttccttaaatgatcttttctggaccctgatgcacttttgagctgacttccaaaggttttctcttctgtggttaaatggcctattgttttcatcatgcatccattcctgtgagaaccacaaattgaaagttatgggattgagccactctgctgagtattggcaggcgattggaaaaagggagaattacacataaatgtaagccatcagtgaattactctaatggaaaggataagacatgtttatggatagcttgcatgaagtagagtttgcagaatttcaaatagggcattatagagacaaaggagatgttgttcccagtggtgtctatgttttagtaggacaggtgggtagaagttgaattgcaagaaggtggaagtaaaggatcttttcctcttgatgcacaagggaaagaaaggaaatttccatagaaaataatggtttgtagaaaatgtaattgtttactgtttggcaaaagaatataaaaccgtgacgttatcacaacatacaccttagatccatttaagtcaggataaacacacattttttcacatagtagaaattacagtgtatattcagttacgcatacacgtttttcatgtggattccacgttgtatataccattgctcacttaggttgctttacatttcttagtattaaagatacaattataatagatttttttcaagttaagtgaaaactacacattttggggattgctgtattcctggatatgagcacctgctaggctctgaaagtttttttgtttttggtgactagcaacaattagatgtatgagtttaattgcatcttgaaagtattggttatttacatgaaaacttttgctcattatttgttgaaagattatacactaaaattattctttttttatgaaagaagttgaacattttttcgtaaatttggtttttctcttatcttcttgtaaaatgtctgtcatttgtacccagttctctcttgtgtgttaaatattttcttaacagtctcagtgactgctatgtatataagcatactaattctgtgatatattgtctcaaactattttcacatatggcaataagagttttaattttaattaggtcttttaaaattatgacatgtaaaaattttcaatttttatatagtccagtatattatttctaatgtgatttctcctatttgtgtggctaacaacttgacacatatagttctatttcatttttaatgactatttagtattatatgaatatatataatttatttaaattatttactgttgagtatatttaaacatttaggaggtcttctccagttttcacctataatcaacagtggtccagtttgtacatatcttcttgcttacatgtcagaatatttcttgaagatatatgcttggaaatgaatttgcatggtcgaagtatatgtatttttaaagtgtcatggatattttgctgtaccgttggtaaagaatatatgagaatactgtttctagacatcatcaccaatatgggtattttgtagtttaaaaaaaattttgccaagctgctagatgaaaaatgttttatttaatttgcatttccccaactacttacgatgttgagaatatgtgctcttaaatctgtttagagtttgtattctattcatagtgtgtttatactcattagtcacatttctattgggttgtatattttcctgtatttatgcaacattgatatgaatgctattttttaataagtttgataaaatttttccccaattttgtgtggtctagaagtttgcatatggtatttcttactatatagtagcttaacttgggaattatcttcatttatagaagcacgtactttgttgattttttcatttgtttcactcctatctcttaaaaaatgaatagatgtatagtcccatttgaatcatataatacatttgtttgaccttctgtaacttaattatttctctctcctttatcaccttccttccttttctttctttccttctcatttttcccttctttccttacctttctcttctgtattttgctgtgtggcctgttttttgtttgttttatttacatatttttattatagaagagtacacataaaatttaaccattttgaagtgtacaattcagtgacagtatattatgtgaggtgatatggtaattagcttgattgtggcaaacatttcaccatgtataagcatatcaaaacattttataccttaaatatatacaatttttatttgtcaactatgcctcaataaagctggaaaaatattgccaaaaagagagaaattgcaaggcttcattatagaatggccagagaattgaggatgttttcaggcttgtggaagtaaccaggaaaatgtgaaaataattgttttttttttttgagtcagattctggctctgttccccaggctggagtgcagtggcttgatcatagtttactgccacatcaacctcctaggctcaagcaatccccctgcctttgcctcctgagtagctggaactacaggcacatactaccatgcctggctaattttaaaaagttttttagagatagggtcttgctatgttgtgcaggctatgttgtcctggcctcaagtgatccgcctcaagtgatctgcctcaggtgatccacctcagcctcccaaagcactgggattacaggtgtaagccactgtgcctggccctaaatgtaatagtttttagagctgtaaaatgtatgttgatgaattcaccaattagtgaattaattcactagttttccttttggcagattcctttttcctagcacacgaaaaaggaaatatgtgttttcttggtatctttcaggccagcgatctgtacatgagacccaggaattatttccaaagcaagattcatatgctgaaggggtaacagacagaacctcaaacactaaacttgattgttccagtttcagagaaaattgggattctg

SEQ ID NO: 8031 - DNA, 601 bp, mus musculus
cctcctcctcccctccctaccttaccttactctttcttcttccccttacctctccctccccctctccctgccttccccttccctctctttctctcctccccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgtgagtcccttgggattggtatctggaaaaggaaggaaggtgggacgtggggatgaagaacagactgggtgtgtggggtgctggctcctgggaacgagaactactgatagggctgggtctgtgtgagaagggaaagcggcagaggaaggatacaatgaaagaggaaggggagcattggcatccctgactttccctccgcctaccctacctcccaagctgaggcttttttcttcctctcctgtcaggcggcgcctcacagtcgatgactttgaaatcgggcgtcccctgggcaaggggaaatttgggaatgtgtacctggctcggctcaaggaaa

SEQ ID NO: 8032 - DNA, 601 bp, mus musculus; identical to SEQ ID NO: 8031

SEQ ID NO: 8033 - DNA, 76 bp, mus musculus
atgctaattaataaaagctgaatcatttcataccagctcttcatagttgtgtgagttattatgtgactgggtagaa

SEQ ID NO: 8034 - DNA, 76 bp, mus musculus; identical to SEQ ID NO: 8033

SEQ ID NO: 8035 - DNA, 674 bp, mus musculus
atccggcaggaatgtttgacatgcagtggtgctggagggagggagtgtgtaattaatgatggttattaaataataatgccagcatcttgaagttctttcctctccacagcctcacaaattagacgccttcgaaatgttgtgcccgtcgccaagatgcacctccatctggggtggaagcaacatctgctaaacagctgcatcttgtttaagagctggtacttaattcaattattcagctctgataggggcaggcagagctgagcggaaggggcaggcccagtcatgggcatatgctgctccacgtcttcccaagttgacccaaactcctctcccacagcgtccccactcgcatctgttgattcaaccaacctagacatctgtacatttccagaaccggccatgctcactcatgctgcctccttgctttttactcaagctgtgtgcccctgccaggaacactcttctgctgcctgtccaactcccgtgtccttcgaaaggcccaactcaaacatcagtatctcctccaggacagagcatagggaattacctcccatgagctctctcggtgcttcatgcattccttaactggagcattcataacattacattgcaattttgtgtaccctgctgttttgtaagccccttaggctgggaaccatgtgtatttcattctt

SEQ ID NO: 8036 - DNA, 153 bp, mus musculus
tacatacaaagatctaacatgccatccagggaccattttacccactgctttgattggttgccaatctcttgtctctctcttcagcaatggtgaggcagataccttttccttggggaagagaaatccatggtatgttgcccttgcaaacaacaa

SEQ ID NO: 8037 - DNA, 284 bp, mus musculus
cgccttgatatggtctgtcatgaggtcccataattgtggcttgccagtgaaacatatcatccccaactggacctgcagaacattgtgctggagggtcacgggccaaatcactaagttccttattaatccgtttcagcgccatagtgtgtgcttgtcgtctggctcctcactctctcagtgtatgctcaaaggtccggccaaaactcttgattatcctggcggcggggcaggattgtctcgtctcacaccagctctgcccacggggctctcttgagggaagatat

SEQ ID NO: 8038 - DNA, 1029 bp, mus musculus
ctaccacctgaattctaatctgagagctgccgtgtgctctcccccagccttttccagtatcctgtttatgtctaaatccaatagtccagccatgccagcttgttaccacatggaaaactccactgctcagagaaagttatgaatccctatattctttatgctttaagattcactatgacatctcaaagtaattggccaggtaaacctaccagatggtttttgggggatgaggaatagactaataatttccattagcataatattgttattataaagatttaatgacttcactgatgtggtgtcctgtcctggtggaaagtttatgagccagaaataaaataatacttatgggtacccatgaggctatttgaaagaagtagtagagaggttaatgagatctcaggtccctaaggctcctaacagaatgttcctatttgagctgagctaagtgatatgagaagcacaaggcaggctgcacagggggcaagggaagctcaatgccagtcgtgcgtctgctgcaacattgcaaattggaatgagggctctgatctggctttggactgcctggatttcattcctggccccattgtgcactgatgtgaacaccttgggcttgttacttaagcaatttgtgctgcaggttttcatctacaaaatggatctaatagcagtatgtaatcagtggttgtcttgaggaatgaggcgatcctcacaaaagtcttagggcagtaccaaggacatagtaaacatgtactgcatattcaccgttattatttttactagttgcaaatcatcagcctgtgctgaaccttaatttcctaatcagtcaagtcaaagaggttggcctaattctgaaattctgtgattctataagccagaatcctgatataattaaaaactattctgttttgaaatttgaatgtgggctctgttctttgcgacccatcaccagactttggaaacaaagtgtattgtacaacaagtgttaactattagaatcagagttctggggaagggccgttgagtgag

SEQ ID NO: 8039 - DNA, 1719 bp, mus musculus
atataatgacgtgaaacaaacttcaccacaattttaagtggaaaaaaacaaaatgcactactacatatattgtattgttaatatgtgttttgtgaaatgaaaacatcatgcaggtatatttaaaaaaacagaacaaaattaaaaagttaggcaatctctgggtggtggaaatatggatggcttttattttgttacacttttccaaattttaaaaaatgtagtaggccgggcacggtggctcacacctgtaatctcaccactttgggaactcgaggtgggtggatcacttgagctcaggagtttgacaccaggctgagcaacatggcaaaaccccatcactacaaaaaatacaaaagttagctgagcgtggtggcgcacgcctctgatttcagctactcaggaggctgaggtggaaggaatgtctgagcccatgaagtggaggttgcagtgagccaagatcgcaccactgcactccagcctgggcgacagagtgaggccctgccttggaaaaaaaaattagtcaatgatgtgttgttttatgaatcagaattaaaaaatccactattttacaaataagcagtgatatacatttaggttgtaattattcatttatgtaacaaacattcattgattatctcttgtgtcaggggctctgccaagtgtatcagcagtgactcttagattgcatgcaaatgaaagaaactctgcctaactccagcaaaaggaatttactagaaggatattaggtagctaaaagaattgccaggaatgtggcgggggatggggaatcccaaacacacgcacgcgcgcacacacacacacaccccccaaaacagcttggaagcagatgaagctagtcagttccaggtctagatatcaggcactttggaaacagactccagccaagaatgacttgttcagagcttgaccacagtccactggctgctatgcttggggttcttcccccacacccagcccactgggcatgggataggagggggggtgccttgattagtaggcccactacccctttccaatgaaagaaacacaagagatgtgatgggtgctaaaaagccaaaaccaaaccaaaccaaaccaaaaaaagacaacagaaatgcccattaccctaggacttaggggtaaacagggttgaataccactcatccctctctttgcatcccataggaaacatttgctatgacatgggagtttaacttaaggttcatggtctaatgttcactgtgatgtgcatcattgaaggtgcaatgtgggtgccccacacagaaggtacattttcctcttggagccagtagtgacatgttgggaagagtgtggattttcagcctgatccttatataccggcaggaattttgaaagaaaggtcccattttctcaggtaagagaaaatcctagaaaggtataatctgaaagaaacaatgaagcagaagcaagaggtataatatggaaatagatcaggcaccaacacaggtctagccttcttttctgaatgatcttacattcagcaagcccaacagtcatgtttgagtttagttcaccatgaataccagcctcttggttcaattaactttggttgataaagttattattaactaaatattaaaagatcatacttagatcagtgcatattcttactgcagttctcatgataaataggaaatgtctgtggctgtccaggtaacttaacaatcatgttgttgc

SEQ ID NO: 8040 - DNA, 236 bp, mus musculus
atggtaaacaacattattttattttaaagttatccaaagaactgctcaacaatatgaacaacaatatgaaaatacatagtacaatggctgatttatggttacttcaaatttcttgtctacaatgtaaatgcctaagtagctttgataatacaaaccaaatgagttcaaggatacctataataaaagatattaatgtgatatagtttaaatatcttgtgtaaaatacttcacttaca

SEQ ID NO: 8041 - DNA, 1856 bp, mus musculus
ttaatttgttcccagcggcagttcattaccaacatcacaagcaaaacatgcgctctccctgggcattgaaggtccaccggaaattaagcagacggggctgcaaagcacctcagagtgaagccagccagcttcatctgctgcagcaggctggaggcaagcacaaggagcggcaggaatgaaaggcttcagcgccttccctggtgtctctgtgccttctgagttttcagctgacatggagcagtgattccctgaaaaggatgggatcttgctccctcaaagatcagccttctttgatgagcctgctccaggtggagtggagcaaccactttagctttttagtgcagagaagacttaggaagtttcattttccttgactggggttctgctttctgtactgacccttcctggtcagtggggagctcggagctctgagttggagcaccttaccaaaatcttctctgagtggggttaagtaagccagcagactctgcaagaacagagccttgctgaatttagctttccagaaagccctattttaagggaactcagtatttcagcaagatgctggattagggggagaaaacaagtagtctgttaattctttgttgttgtcagcagccttgcaggttcctggaccatgacacatcagcacagtcctaagtaacagaagactcaggtcctcaccatgacctcaaacagcatgatctctgtgaatctcagtaaatcattctgagcttcactttccttgttcacaccatatagctatttatatctgctccacatgatgggcaaggtcactgggaagtgtagattatataaggcatgggaatggcttcacaggttcatgtgggacatcacatggtgaggcacagagatcagaaggtttgggttcaaatcagctctgccgagctggagaaaccatgttagtacttgaccctggtgtttcaaactcaaaatcagaataagattagggataggaaaaagaccacacgagatacttctgagttttaaatgatttatttgaatgaggtcaactttcgttcacttctaaaggaagatagaagtgtgagttttgtaattagcctagagaaccgggggagcaagaccctactgaacaagcctcctccagagctcgccccaaagtctggagtgcaaaatgtccacctcgttatgattaatgaagcctctggatatagatcagaagactagaaatgtctgtgaaaggagctcttccaggggctcagccaaaaccaggagaattgccctcgactcctctctttccttgtttctaagccatcggcaattttgctcagctccatcgtcaggaagtcccaaatcagaccactgctccctgattccacagcttccgtcctggtccaggctccataatctccccctgaacctctgaaagagcctcttaagcagactcctgccgctccccacccttgcttctcttgtctgtttcttcaagcagccaaagggatccctgttaaaatgttaagtgcaatctcatcagcctctgttcaaaaccctcagatggctttaagcagagtaaaatccataattctcaccacagccagggggaccttggtgacctcattcctccatgagggtatctccctccactctcctcatcccgttttctgttccagatgcactgaccatctagtcctacctgggaacatgaacaccaggaatgctgctgcctgggaagactttcactttctgttctttctgcctgaaacactccttcctgggaatccacattaatccatattctttctttgctagagtctgactgaaatatcatctgtgcagagaggcctatcttaccaccctattttaaataatacatg

SEQ ID NO: 8042 - DNA, 351 bp, mus musculus
tttacataagtgtagtttgtacctctagaggcaacataaaaataagaacttccagcacccctgaacacagttgaacgtgtggacacgtacgagtcggacttctggtcccttcctttcatgttagagagccacccctaatttctagcctaccccttatcttcagccagaggaatagcagtggatcctttccacagcctacattctccagcagctgccttcattccggcttgaaaggaacactctggcagcccattggcccaagagtaaggaaatggttgcttagcaactgactcctgcccccaccacagtccctgagaagaggagctcttgggccaatcacctagtttctgc

SEQ ID NO: 8043 - DNA, 351 bp, mus musculus; identical to SEQ ID NO: 8042

SEQ ID NO: 8044 - DNA, 330 bp, mus musculus
cacataatgtttttaaaatgtataatttcattgttaacatttgagaaattcagtatattgcacataaatatctggattcccagcctttcttgaatagcctgaacgtctgctgacgcgagacacctatgcctgcatggcatcagttagctggagctgaatgtgggtgtgttgaccgcagtcgccatcacacccttttgtctttccctcaccgcactcctatgtatattttgccaatatggcactgtcagtgtttggtgtggtatccctgctgtaaatcaagctaatccataggcatcacttcatgtgctgctctttatttatttactgaaa

SEQ ID NO: 8045 - DNA, 401 bp, mus musculus
ctaaatattttcctttgaccaatatgagaaatattcccattgatatctctgtgcatttaaacaattgtgaaaatagagaactcagttatagttaaatgactgatgttctataagataactttatcacatagataaaataatgaagaaaagaaattaaataggcattcctctgagagtttctctgacaatcaaatcagaggttttgattgaaaaattccctcattaatgtagattgagtgaatgaactaattactttgtaatttgttctaatagaaactttccactgaggtgaggggcaaggggaaaccccaccgtcttcactgtcatggaaaagataaagaagtaatggatctttgaaatatttcccctaactttcaaaaccttagcttacagtgttggag

SEQ ID NO: 8046 - DNA, 1056 bp, mus musculus
ggagacacagacaataaataatacccatagtaaaaagcaaattatataatttgtaggaaaataaggactatggaaggaagaaaaatttgggtaaggaggaccaggagcctggggatagggaggtcagggagggcttggctgagaaggtgacatgtgatgcaactgagggatgtgagggaattagccatgcaggtaggggaaagagcatcctgggaagtggggacagagcacagacatgctggagaaacagcaaggaagtcagggaggcggaaacagagcaagtgaggagaagatagtgggaggtctcaccagagagggagccagaccctgttcaataatgcctcgacttgagcccagcatgctggctcacacctgtgatttcagcactttgggagcgaggcagtaggattgcttaaggccaggagttcaagaccagtctgggcacaatatcaaaaccccatctctacaaataaaaaataaataaattagctgggcatggtagactggacttggtggctcacacctgtgatcccagcactttgggagctgaggcaggaggattgtttaaggccaggagttcaagaccagcctgggcaaaatagcaagacctcatctctacaaataaataaataaattagctgggcatggtagcacatacttgtagtctaagcaactcaggaggctaagatgggaggatcttttgagcctgggagtttgaagctgcagtgagctatgactgcactccaacccgggcaacagagtgacaccctatctctaaaaataataataataataaattcattgaataatgccaggagtttttctctgagaggagtggataggtattacagggttctttgatggcaaagaaccgaggaatcttattatccccacctataggaaaagcacctagggaggctggctttccatgcagaggaggaaccaccagggggcggtgcaccgcaaagtcgggctgtggtggccctgcagatggcggtgaacgggaggagcaggctggcttttccaggctcccgctatctaataagtgaatagcat

SEQ ID NO: 8047 - DNA, 1056 bp, mus musculus; identical to SEQ ID NO: 8046

SEQ ID NO: 8048 - DNA, 1098 bp, mus musculus
aacactgagttaggctggtgctagagtctgtgctcttaactgctattctatggcatttttaggcaagtcaggtccagtccacctgtaaccctacacatttcacatacatacaaacacactaataaatatgagaagtagaatctgaactgcagaaacgttgtgtattttatttttattatctgtatttttgccttatttcctcacttgaattcaacttctttcaccttgacacactggagagccagagatagaaagacccctcacatatgccagccattgagatcattaggatgatgaacaggacacaatttttatggagagttgtgtggtcaggaggagagttgcaagaaccaagaattatgtgctaggaaatgtgtgttaaagtagagatgtatacagagtgctgtagaaacatggagaaagattacttaactctgatctgggcaagggagagggggcaggaatatcagacaaattttacagagggtgttttgaaggaggaataggagtttgacatgtgagaaagtaggatacggatgtcagtaccctatgcaaaggcactaagacctgggcgaggttagcattctgagtcagtgaagagggtgcatttgaagcatgacgccagagagaagaacagggtggaaggtccagatttcatgcagagtcagcaaataggagtaccttaggtcttgacgtcataaacccaaggatcagacaattttccagtgtcaacaaaagccaccataactgatggaagttaacaagacagggtgcagagaggtatgtaaaggaactgagaagacaagacattggtacaagccagtctccagtttcctctattttcccttggcccaaagcactgtcactagaagatttcatgtgataataataaattttctgtgaaatagtagaagcattatggaggagagcagattctgtgcgaggtatccacctaagacatgcatagccacagcactttgttccctgaaactagagtgaataaataggatgcctccagaaaacaaaaatcatcttcaacaagatgccttttacctatttcttgtcccttttatataatttctggcatatgtgtctata

SEQ ID NO: 8049 - DNA, 1098 bp, mus musculus; identical to SEQ ID NO: 8048

SEQ ID NO: 8050 - DNA, 614 bp, mus musculus
gccaaataatatgttgcattttaattttttttgcagtcctcagtgaatttttatgtgtctctctgcgtgtgtggcatgtgaaggaacacaaagttagaaataagagagggagacaacctgtggggtggccacattccagggtctgatcctctttggggatactgtgatatgctgcccagatcctcccatcagtgctaaagaagacagccaagtgggagacagtgaggcaacctaaatgttctcaatggcaggaaaccattaccagccctggaatggaaaaaatacagggggtggtgctgtcacctgcccagaagccaaggtcattagacaggagctgagaccatgaagggatgaactgtcccatgtagactggaacttcagaaaaagtacagccattgccacaggtgcccctgaaacagaaagagagaggaaaaaacacccatacatattcccgtttataaattgccaggcttctgtcagttattcatgttgtaacaggaagctacggggccatgtcaccagggacatgtgcatccctggcacacaaagccgaacagggcatggagccgagggtgaagagacaagtgacaggcaaatggcacctgctcagtcaa

SEQ ID NO: 8051 - DNA, 614 bp, mus musculus; identical to SEQ ID NO: 8050

SEQ ID NO: 8052 - DNA, 706 bp, mus musculus
gcaggtgagcagaggtctcaggaatctgcaaggcaagaaagagagactccaggatttggcatgatctggacctgtgtttaagtctcagctctgccacgaactgtgtgacttcagggaagtgactttgatctcccacagccttgatttcttcatctgcaaaaatggagataaagtcgaatacgacggtatgacgttcatggttatgtgtgtgaggtgtgtgagcgtgtaaaggcctggtgcaaaggagacatctgtaggaagcggcagctatgactcctgctaggtggagactattcactgcacacctttttatctgcactaaaagatgcacatgaggctcttcattaaaacaatgaggcagccaacatggaaacttttctaagagtaagctattaaaatagatcaatcagctaatgacacctccagacaaaatttgtaaaggtttggaactaacattccctccctcctttccttccttctttcctttcttcctaaagccattaagcaggactgagaaaaataggtgtttgcattggagagaggatggtgctgaggggtcacagggtttggacagagtcggaagggcttctctgtcccagactactgtgaactaaagagacacaacaactgaatgctgtatgatcctagattgctattaggttattcttgaaaagtggcgaaacacagatgtgatctgtagcttaga

SEQ ID NO: 8053 - DNA, 706 bp, mus musculus; identical to SEQ ID NO: 8052

SEQ ID NO: 8054 - DNA, 2586 bp, mus musculus
gtctatctttcagaacccatgaccatggctggaatttttagtgagcaccttttatgatacagtcactacgctgacactacaatcatggcagcagtgattctcggtctactgttggtggaattgacagaattacggaattgttaagagcttagcagtaggccaccaaaaaatcgctacaggaaaaactcagtgttcttttgaaaatggaatacgcttgccaccaaatttagctcccttcatctcctacagaaggtatcagcattattatttgaggaggcaatacagaaagccaacccctttgtcaaacaaagccagatacttaatagtttaaggataataaggttttccaaactgctgtaccactgaagtgtttttcccataataaacaaggttggatgagacaaaaattatagataggacagtcttatgctgcaatgggcaaccgcaacacaaatgcttcagaatagcagtgaagataacgtgaaatggccaggtgcagtagctcacgcctgtaatcccagcactttggggggccgaggcaggcggatcacctgaggtcaggagtttgagaccagcctagccaacatggtgaaaccccatctctactaaaaatacaaaaatcagccaggcatggtggcaggtgcctgtaatcccagctactcgggagaatcgcttgaacccaggagatgaaggttgcagtgagctgagatcatgccactgcactccagcctgggtgacagagagagactccatctcaaaaaccaaaccaaacaaaaaaaaaaaaaaaagaaaaaaaaacataatgtgacatgaatctagccctgctagatgcagtttttcatctctaaccaattttcatatcttggcctggccctcttgtgtttctcccccaacattcccaacatttctgcccctgtgccttgcattgaccaaaggtgccaacaaagattgcttaagtgtactggtggttctcggggctgaaaggggtaatggtatcaatttaagttgttctcgccaagactggcccagctgtggggttttgagaacgaaactgcctcagtttctttgtttagaagatgtaaatactaatacgtgcctgaactctcttacaaatgtaaacatgaataaaatgccaaaatatgatactttaacgtttggaaaagcacttggtaaattattagcatcagattatgctatttggtgctgttggcaaatggtcctttctctagctgaggctgctccaccaaaagaagaaatgatttttacaattagtaaatatgaaattttattctactgaagttgatttaaactttgccctcaaattaaggacccgtgaggttaagagaaattgttttgctataatttagagaagtgggaaatttgaggtcttaaaattaaaacatctacacactgacaaaaatactgatggcgtgaatttttaaagtcatcttttctctgataataaccagcgtatctgtaaagaaaaaaggcagtacacttctctctacttcttggttcacatgtatagaaggacatagatttgcaaggagataactataccaatatgcacttcccttccccagggaggattatacttcctcatcttactgaaattggatatggctgtgtaatttcctttgttcaatatataggcagaaatggcatgtgtcacatcaggcagaagcatgaagactcacgctctattctttccccatggtaataaccagcaatatcccagacaggctgacctgtcaccatagatccgggagtgaagacatagtggagtttcaggcaaccccagtgagaaggtgtcatgactgagaaatcaaactgtgttttgaaatttgggggtcatttgttaccctatggtaacctgtcctatactaactgatacataggccatcaacatttaagtaaaaacggtaagaatctaaattatcctcttttccaacctcttctttggtgactctcaacttggtttaagatgctgccagcatattggccttctgtccactgctacaacacgccaggttccttccatccttaaggcctctaaacttgaaagctctttcttcccattctcatgggtctggtaccttgtcatccctgagatctcagctgtaatgtcactttctagacatgccgtccctaatggcccagttgaaaatagatcccttttccctacttgtgtttgcctatctaactcctgtttgctacttcagaacacctacaataattttgtaattgtttatttgtttatagggcagagataaaaattatatgtcacaactcagatgtataaaataacgtagctgctctccaacccctgacacccccaccaaaaaacaaacaaacaaacaaacaaaaaaaaacccaagcttatcttgtttccaagctctattcaaatggtcacaggggattgtggtaaaataatttaaatttgtcaagtaaagttatctagtcatttccagtataaaatgctttggaataaagatttggtcagattcaaggtttaaactccacactaatgctatttcttgccacctaaattttgtgcccttctcatagataaaggcctttctttct

SEQ ID NO: 8055 - DNA, 1553 bp, mus musculus
ataaacacaggactaagtctcaacaattagcaccaaatattggcactcttagttcagggaatgaatcactataagataataattttaaaaagcaacaaataaaagcaagcagaattgtggcaaacacgctttgttgcagcgaaagtgtttagaatttaccctagactcgccataacgtgcaaccaaagaaacagcatgccaacattaaaccatgacatctccctggcacatagacaggccattggccagatggttgcagaggtgaaggcactatcccagtctagtcctaagccaaaagatgacttagtgagagccagtctcatgtctgagaggatgaagatctgatctgaggaagaaaccttcctcttctggcccaaccacagatgtctggcattcttattcctgtctggctattaaaggcagaagttttcagtgtgattgtattcaacgtgtgttcactaactacaggctaggggagtcctaatctctctgctttgaataacttgctcaaagctcaaaatcccatgggtaacatccagctggctggaggccctaggccacatgctcaattctggcggctaagatgaggagagagcaagcatcagactgtatctcctttcttagtgaaaagtgggctctgcctcttgtcaatggaacattctccaaaactaggagatgggctcagtacagggcagccaaccaatgacctgtatccaccataccatctttctcctccctgcaaatgccagctttgtctccttttcaggatctttgttcttgcagttcccactgctagcttctgtcccccatgttaatgtggctggctctgtcccatccctcggttctcagctcctcagaccacatagaatacctgttctccctgaagcctctctgaaccacctctccctttctccctttctttcctaactcatcagtccctgacaattaccttgaacattgctttttcctcatgcattgtacatcttgatcattccaccagtatggaaactccataaggacagagagcctggctgtcctgttgctcagctctttccccagtgtcctgtctgccatgatcacagctcagtaaatgtttgggaagcatgaatgaacttaatggcttcaagactctgccccaacattcttttgggtcatttattgcagacgcatctgcttccatttctcaggcaccaggattctagtttaatgccctgacttaacatttgcctttagccaccaactggatattccagcttttatctaggtcttctccatccctcattcttttgagtgagtaaacctccactccagccattagcccggagatgccagcctcaaccctttgagcacctattttatccagttccacctcagtgttgggggattgggaggggtgtggggaaagtgaggaagaaggcaagaggagacacttggatatgaagtatgactagcttcaagaagggacagatttgtgagtgggattaaggttaggggacagatacagaaaagcaatgtgcagtgtgcagggactggggcagggccctagaggaaga

SEQ ID NO: 8056 - DNA, 1271 bp, mus musculus
ctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcaggcctcctcccatcaccagcagaaagcccagagtagtccctgaagaagctgaggggcgcatacctctggggtttgggttcccttcagggaagcgaagggagatgacctctttccaggctggggaccaagagggctccctagaagatattagcaagacctcagtggccaacaaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactggggtaactggccgcgtgagcccccgcccccaccgctgctccccgcccatgggggctggccgcatgctctgtagtttttagaagcatgtttcagtggcccctcgtcatttctgcaatcagaggctgcttatccatccctgtgagttttttccctaaacgggcctgggtgtagctcaggctgaatgatgggcttctctgcttggcccatgttagcttggccacaaagaccctcagcttttggtgtgacctggtgcccagagggtcacacaacccccatggagaaggtggcgccaccaccagcaaatgacacacctgctttgccttgccgctcatacccgctgggttcctgcctaccttgcttggcttgtccagcgatctttcttcatcctttcccatccctggttctcccgccttgggaaagttgacagtccagaggtttccatccttcacttctggttccctctcagtcccagtgccaagtttctttctgcctccttaagactaactgtcttctctaatccagaaca

SEQ ID NO: 8057 - DNA, 1271 bp, mus musculus; identical to SEQ ID NO: 8056

SEQ ID NO: 8058 - DNA, 1271 bp, mus musculus; identical to SEQ ID NO: 8056

SEQ ID NO: 8059 - DNA, 1262 bp, mus musculus
tccctgggagcccccccacccaccgcctctgccctccccacgtcgagagccgttgcccgtcaggggaagctgcactcccacggcccatacaagtgggaggcctctggggaagcggccctggacattccgtttgcctctctggaggggaaggggtggcccagagcgaacccccacaccccctctcccattgcctgctcaccccatcacctcccctccctacaaggccctctgtgcagcccgggctggcacagcaaggaaggggggctcaccccagagcgcccccgcctgccagcccgtgggtcgaggccaaataaggccggacggcagccgagggcccccgcaccccgcccgcggccccgccccgcgcacattcttctgccttgtaaggcccggccgccacgccccgcccccgcctggagtccagacccgacggccggcccagttccacgcacccagcgagcccaagcgccttctccgcaccaggtgggatccggggccccgggggtcttgaggacaggcctaacggcccagggctggagatgagaggtggcccgggcccgacccggctgtcacggggggcaaaggcgggccccacggactgggacgtggtagggtctgttgggcacggactgaggggtgagctggggcagcgagtttgctgggggccgacagggactctggccaggggccgggcagcaggaaggctgttctggcctctgagaagcagtggtcctgcggcaagggaaggccatcgtccaggccctgcccctttgctgaggagctggagatgccaagcccagagctccggggggggctggggagcccgggtacaagggtgctggggagagggttgcagtcgtcagttccccctggcccagtaaaggcatgtgtgtcacagatggagaaacagccctgtgggactccacgcccccacagcatctgtgtcccctccccatctcccatccctacaccctgggccaggggaaagggaccgagaccagggggcccttccgacacagccagtgctgtatgcagggacccgggccttcccctctctgggtcatctcgcctgtgggtggggaaggtctgcggagggccctgatggactcacccctagggggcaggacgaggactagtggctgggagaacctgatccctgctcttcccagccctccagctgctctaaggaggagactcagatgaggtgcactgagaaggaggcatctggcctgcccagctccaggggctggaggtcatggggg

SEQ ID NO: 8060 - DNA, 1433 bp, mus musculus
ccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgttttt

SEQ ID NO: 8061 - DNA, 1433 bp, mus musculus; identical to SEQ ID NO: 8060

SEQ ID NO: 8062 - DNA, 1433 bp, mus musculus; identical to SEQ ID NO: 8060

SEQ ID NO: 8063 - DNA, 1433 bp, mus musculus; identical to SEQ ID NO: 8060

SEQ ID NO: 8064 - DNA, 2497 bp, mus musculus
tccttgtgattttcttagtccaaattcctaatgtcacacagagagggtctggagagtgggtcagtccactatgctgttgttctttccactaccacatggtgtggctgttgacccgtcattctgcacagcccattgtcctgtgtagtcacctgtccactaggactgttgctcccgtcactaccacacggtgtcgctgttgaaaagctagcctgcacagcccaccttccctgccccacacttgggctccccgtttcatccatgttctcctgcccagccattgtccccaaaagcagaacaatgggccaggtgacagagtccattggggttttctgcttcagtcacatctttgggtgcaattagcacttccccatgactctcccagctctagtgtggaagccagatcaccaacccagactgtctttggaattctggggagtttccttgggggctttgggccatttcctgccatgggacatcagagggggctatctcagcccatgagatggggttttatggattgtacttcagattgattgaggagtcctggaaggcctttctacactgctgacatgtgctctgagaccataaggatgagcaacaacacactggaggagttcgatgcagacggtggagtgggggaccacatgaccagatttagtttttaaaatgttttattgtgacttctgaaagcatcagaaggacaagagggcaagggatgagcacaaattaggaatgtgttgttattcaagcttcaaccagattggtgatggtaaaattgaagagaagcatttgtagcgagcaaaagcagataaaaggtatttattttatttataaagaaaaatgtacacacttctgctgacatcattgattctctgtcaaatggagttaaaggctctagggccacacaagaagggagggccattgatcaaacactctcaggagtcaagcaaagggcatgaatgatctaatttaatcctgatagcattcttcatcccccaagatggcaattgctcaaacttttttggttgtttgtttttgagacagagtcttgctctgtcacccaggctggagtgcagtggcacgatctcagctcactgcaacctctgactcccaagttcaagcgattctcctgcctcagcctcctgagtagctgggactacaggcatgtgccatcatgcctggctaatttttgtatttttagtagagatgaggtttcatcatgttggccgggcaggtctcaaactcctgacctcaggtcatctacctgcctgggtctcccaaagcgctgggattacaggggtgagccaccgagcccagctgttcaaacattttaaattgagttacccttccctgatcacatagccagcaggtggcagagttggaattcccaccttatctattcccacatgtcagagcccatgctttttttgctcctccccgatgtcaaaatgttgtctgttctgggggacttggcacgtttaaagcagaacttctttgttctgtggcataggttgtacactgtaaaacataggttgtaccaggttgaggaaacaaaagtctttctctaatttgtccaccagtagtatgcatctttttctccactagccaggggctatggaggccctgaatagaacagaagagcagctagcaagggcggaaggaagagagagaagggaagcacagcgtgggatagactgggaggccatgaggactgttaagggctctaggttttgttccaaaagataaggcaagccactggagagttttgagcagaagaatgttacaatccaattcacatttgtaaaagagccctctggctgctggggagactagctggtagatatggacacacacctgccatcccccaccctcattctctttggagttaacccccttctacacctgccctctactttctgtaacatataggcaccccctgctccacactctatagaaaaaaaaaaaaaaatgcaattattaggttggtgcaaaagtaattgcggtttttgccattacttttaatgcaaaaaccgcaattactttttttttttggagacagagtctcgctctgtcacccaggctggaatgcagtggtgtgatcttggctcactgcaacctctgcctcccggattcaaaccgttctcctgcctcagcctcccaagtatctgggattacagtctcacaccagtacgcgcggctaatattttgtgtacatatatttttaaatatagacagggtttctccatgttggccagagtggtctccaactcctgacctcaagtgatccacccaccttggccttccaaagtgctgggattacaagtgtgagccactgaatccagtcttggccgttacttttaatgccaaaaaaaataattacttttccatcaacctaaatctttcttggacctgaagattggtgcatgaaacacattgtgcctgcgaacttctctctaatggctgaggaaaggcagttgcttgggggttagggtttgag

SEQ ID NO: 8065 - DNA, 969 bp, mus musculus
ttacgctccagactatactaagcattttgcctgtattatttcattatagcctcaaaatcacactgtggagaaggtactattagcatccccattttatagggcagtggagacatagaaaagaaaagcaacttgcccaaggcccaatgtgagtaaaaggtgaaatgagaattttattccaggcacttggaatctagagctccacactccactgaacgaatgtattctgtattctcgattatctcattttacttttaaatttctggtaataaactatactatagttttatgctcctgtaaggtatcaactaaagtgttaaatagaagcaaggtatcaagattgaggccttccatcatgagacattattgaaggtgcatcttcaaaagtttttgctttggggaaaactttagtaattacagtacaagacaaataatttaaaaccccaaaagctgtggatatgtaagtgttgagctttatttcttgtatttaggatggagcttcattccagtgtgagaatttatgccttggtgcgctgaccactccataaatctaaataaagcctcacaatgttccatgtactatgacaggtgggggatgcagagaatagtgagtaggagcataaaatctggagcagaaatggctgcatctgaatcctggtactactactgggtaagactgggaaacacactttcatgttccttgctgtcaaatggaggtaagatggcacttgtagggttgtagtgaaggagaattaagaacaatgttatcttccacaattattagacatagtttaattaccaggacatagtgcctgctattaaactggacatgaatgtgaacaggtggatacccagatataggtgtgaaaagagaacagggctttgacacagccagtggccagatttaaggaaaggtgtcagagacagtggggtgtaaagctgaattctcaaagatccacaggtgtgtccctg

SEQ ID NO: 8066 - DNA, 1323 bp, mus musculus
acgtggctaattaagagtttgactcatatatttttgataagaaaatattggggaaaagtctaaattatttataaactaggattatgtattaaaagcgaattcaatatacatgtgtatataacaaatatttattgagcaactactgtgcagcaggatgaagataaaatggtataagaagagattcctatttttcatgtaccttatggtttagttattagaaagttgttttactgccaataaatataagggagaaaaaaattcaaaattatcaaagtttttaatagggactaactcaccaatgacttcgatgtttaatgaggccaaaactcagtatttggatccctttgatgctagtatcaaggatgttgattttcttaccctcctggtaaagggaaactggatatgctgaaagctccttggcattaaaagccaagaccaaagacggtaatgaaatcatggtgcactcaagtcatcaccaacagggcagcagaggttagaggcatccaattatagggagcccctgactcatgcttcctcctggttccctgtctcagaggcagctgagaggctggtcttggaagtatatctgtacagatggttgatgtctaattaacaagggacccaataacatctttctgaaagtcccaatttgatcatattctcttccaaccagttgtatcgcttcagtggcttctcattgctattggggagaagactgaaatccttaagcagtcctacaaattcttccataatctggatgctgcctgcttggctcctgcgtcttctcctcattctctggagaattcaattgcacataccatataccttcttacattgggcatttgaacatgcatgccatctacctgaaataatctctcacttctttccttgactttgtttcatccagttaatgcactcatcttccagacagaagcctagggatcattgccttagacaagccttcctttaccttcctggactgagtcaattccccttattatttactttaatgccaccacatataacttctccatagcactttaacttaattgtaatgttatatctttgattaatatctgcctgagggtaggaataatgtgttttctattccctttcattattttctttctttcattgatgcctttgggtcctagagctgtgcctggcattgagtagattctcaatagcaggttgttgaataaatgcacgaataataatgggagtgtattgctaacatctggaacagcatagcctagcaggataggctgcctaaaatttcatttggggaggaaaactaaagacgacttcaggataagtgtctag

SEQ ID NO: 8067 - DNA, 1124 bp, mus musculus
aaagagcctgaagttactgatgcaaacctgcatttcttcaggcaactgcaaaagcaatgtccacagtagagaggcaaaagctatgtttatgcactttcctgtgtatttatttatcctggcacaggaattttcaaacttgtcattttaaacccaaggaatttttcatccattttggaatttcaatcaccatgttactgaataaaggagatgatgtagggacagccaagctcttctgagtggcacaaatctagtccctggtgacctgctgccaaaaagcattcaaccaaaggaagctagaccctggccatgaagtggcattcttgtgcaagatgcttatctgaatggcggcatgcttcttgcccttgaattgtgattaaatcttgatagaatagactcttctctcggggtctctaatttctagagtggtaaacagcacctaaaagtccatctggtccagacacctgactctaggctgagaaataaataaatgctccaggacaacttgtataccagtcatttgcccatttgttctcagatctcagacccttcctctgctcagctctatattgtatatggctgagttcttaaaattacattccccaaatctctcaaaactggcttatgattagggatggcccaccctaatcagaggtactggtggaagactgaagaagaggaggaagggagaagccagagtatcttccccatcattctttgacttaggccagtgactggaactctcctggctcccattggtgcaggatggatttagctcccaggctcccaggctctgttagctccacctcctcccctctgcacacacatcccaagtttaagctattgatttcttactcctgatgttctggtgccaataatcatgtttctaccactgatttcttagcttcttctactccagattaaatgtttccaattccatcccatactttaaagctgctgaggtatcttacaggataaagaaatcctcatcagtctaccctccttcaacctggtacaattatggatccttcttatccatgagcccagctcgtccagaatctcatgaggtcatcagggcttggatctgagttctttcagttagtatgtacttagctctcaaaatgctc

SEQ ID NO: 8068 - DNA, 267 bp, mus musculus
tgggtgagcaatggggtatttggaggctgggatcatctggaaagtggacagcaacaggcagcttagcagaatctgctggccaagttcacatgcctgccccttcccccgcctccctaaggttcctctaaaggagctccatccagcttcctgagtgaggcatttatttgtttgtttgtttgctggcttgtcctacagatcaactacaaggctgtcggctcgctggacccaagtgctgacctctcgagccagagggggaaagtgttcaag

SEQ ID NO: 8069 - DNA, 3928 bp, mus musculus
taaaataacctaacctaagaacccgctgtgaccttgggtcatgaccctgcagtctttttttggcagctgtgctcacaaatgtgtacgtgcagacatgtcttttgtttttcttttacaaaattggtacccctacaacacctactattttgaaacttggttttttgcttgatattgtatcacatgtatgttcctgttttggtttatataggttttatatagtttttggttgtgtaattttccactttatatatgtaccaacatttatcaattcatttattgattcattagtcaaattgtactgggcatctactatattccaggccctgtgctcagtgctgaggattcaatagttgaacaggaagtatttgccctcctggagctgatgttctagttggagatagaaaataaaaactaataaatacgtgataaggcatcagtgctacaaagtaaaatataaagtagacaaaatgtatagggaatgagcaggactggtatcagagtgactaaccatcctggttggcccaggactatagcggttttagcactgaaacccatcagtcccagacaaaccaagatgacttgtcacccgtaatcagtacaagcctctccaagaggtgactttaagcagaagcctctatgacgttagtggaaaacagccatgcaggtgcctgggggaagagtgttgtaggcagagggaaaactaagtgcaaggggctggaggccagagagcacttagtgtgtctgagggacagcaagagaaaggagagaggctgagggcagtcaggaaggaggggagtggaagccaaggaggagatggagacagcaagctaggtcatatggatctcataaaccatggtagaggctttggattttttttttttttttttttttgagacagagtcttgctctgtcaccaggctggagtgcagtggcgtgatctcagctcactgcaacctctgcctcctgggttcaagctattctcctgcctcagcctcctgagtagctgggactacaggcacatatcaccacgcccagctaatttttgtatttttagtagagacggggtttcaccatgttggccaggatggtttcgatctctgacctcatgatccacccgcctcggcctcccaaagcactgggattacaggtgtgagccaccgcgcccagctgaggctttggattttaattctaggtgtgttgagaaaccactggagtttttgagcaactaaggcacatgatctgatttacattttaagactcaccgtggcttttcatagagaaagattgtagtgggtaaatggagaagcaggggtcagtggagaagccattgcaataatccattcaagtgacaatgggggctcaggcagggcggttgcagcaatgatggtgagcagcaatggtttctggatatattttgaatggaatttcatgatggagtggaggcggagtgagggtgcaagctttctagaatgaactcaaagttgctggcttgaacttttgagtaggcggtagtgccattattgaggctgaagactgagggaggagcagactggggcagagtggaaggaatatgagtcaagacctttgttttggacatgttaacttcgagataccagccaggcgcagtgggtcacgcctgtaatcccagcaatttgggaggccgaggcaggaggattgcttaagctcatgagctcaagaccagcctgggcaacatagtgaaaccctgtctctacaaaaagtacaaaaaaaaattagccaagcctggtggtgtgtgtctatagtcccagctactcaggaggctgaggtgggagaatagcttgagccagggaggtaaagattgcagagagcctagatcactccactacactctaacctgggctgcagagctaaaccatgtctcaaaaaaaaaaaaaaaaaaaaaaaaaaagattgagatgctttggctgggcacggtggctcacacctgtaatcccagcactttgggaggcaggggtgggtggatcacatgaggtcaggagttcgagaccagcctggccaacatggtgaaacccagtctctactaaaaatacaaaaattagccaggcgcagtggcgggtgcctgtaatcccagctactcgggaggctgaggcaggagaatcgcttgaaccagaaagcggagcttgcagttagccaagattgtgccattgcactccagcctaggcaacagagtgagactctttcttaaaaaataaataaataaataaagattgagatgcctctagacatctgactagtgaattgtcaaggaagcagttaaatatttaaatccagagttcaggagagaatcagaactaggctgggcgcagtggctcacgcctgtaatcccaacactttgggaggccgaggcaggcagatcacttgaggtcaggagttcgagaccagcctggccaacatggcgaaaccccatctctacttaaaaaaatacaaaaattagccgggtatggtggcgggcacctgtagtcccgggtactcaggaggctgaggtgggagtatcacttgaacctgggaggcagaggttgcaatgagttgagatagcaccactgcactccagcctgggtgacagagcaagactctgtctcaaaaaaaaaaaaaagaaagaaagaaaaaaaaagatttgggaactgacaagtatagttggttaaaccactaaaatggtagtgatcaactaaagaacaagtacgtgtagacagaagcccaaagactaagccctgggataggcctgtgtttaaggataaaaagaggaggaaaatccagcacaagagatggaggaagagcagtcagtgagctagaaggaaaaccaagagttcctaaagccaaatggggaacatgagcacaccaaattcttcagagaagttgaataagatgaggatgaggaactcatcactggctttggcacatagaggtcactggtccacggtttcattgaagtgttgggatgagagcccatttggaacgggctcaaaagagaacaggaagaggactggagacaaggagtccagacaactctttcaaagagtttagctgaaaaggggtacaaagaaatgggaccatatctggacacggtatatggtcaagagagggagctcttgcagctggcaagtgttctgaagtgctctgtggtgggacacttaggttactattagcacaattattttgctgttataaatagtgctgctgaatgaaggccacatcaggatcttgtttttgaaaataaatgtccttgttctgggtatgtgttttgtcaacatgacatcctgctgatcatgaattggttccacatttctattttgttcaagatggaaggctttgatactgtgcactcaggttttctctggtcaacacttccagatcctccgcatttcagaacccacagagaacccctgaggcccctgggctcagttccctccctgaccaactttctgggccctagccccatgtgtccctcccctgtagtatactgtagccacacagaaagtttgagaagggcaggggctgtgggcccatcaactcctttattcttgagaacatctgcctacccctcgggatcctggggagaggaagggaccctgtgagaacctaatgaccgccccaggcagcaaggccttcatgagccagggtgctctctgggaccgtttcttacgcagcaggagagtcgtgggccaaccaggcctgccctgaggactgggccagagcccttgaggggcccgcagggaaaggccaaaaggaccaagtgctcattaaagaccaaggcaggctggactgagctagacacccaggctccaggttccttcctctgaaacatctgcaggtttttgggaggcgaagggctctcagctgccatggctgatgtctggggactttttcttcagctccagatggtctacacagg

SEQ ID NO: 8070 - DNA, 691 bp, mus musculus
atcactgttattctcataattagtcaaggaaggcttcccagaagaaatgacttggagctgagctgtagcagtagcaaggcaacaatggaggcataagcattccaggcagaaggaacagcatgtacgaaagtcgtatggtgggaacagaccgtggtacatttggggagccgaacagggctagtggggctggagcagagtgatcaaggaggagtgggaggagacctgaggctggagagatcagctgggggcctgaggaggtagggcctgggggcttttttttagggctgttagtctttatgctggaagcaataaatgccaacaaggggtttgtaagcagtggggaggcaaggtctccctgttgatttgcaaagctccctctagtggttttggggagggctgaggatggtggatgagggcttttggtggggtggggctgggagggatggagagatgattgcagagaggagtctaagatgcgcgcccgcaggagttggtgatgcatgtggtggttgtgaagggtgaggaagagaaaggggacaaggacaacgcccctctcttttggtttgtgtagccactgggtgggtagtggtgcctgagaatgatggtgtggggggtgagattacttctctgagcctcagcttccttatttgtgctcccagcctgtggtggggattattaagtgagagaatgc

SEQ ID NO: 8071 - DNA, 1527 bp, mus musculus
gagggttatagctgctgagaaacttgggaagctggagggcaaccccggccctggagctgacctctaccctctgtctctgccattgtgggggctatggcagtccaagttgggtggcccctcagccatcaggctgggcacatattttccagatggggcaatagaagcctattaattcacaaatatttatgtccctattctgtgacaggtcccatggaggccatagatgagtaagacatgggcctgtggccctagggggcactactagtgaggaagatactgtagtctcagtggggcatggaagctctgctgcagggtgctgcgccccctcccctgccgctgcaggatcgctcatgccggggccaccataccatgcccctctctggcctgtccctgtgtgagcataatgctgctgctgcaaagctgcctttatattgcattgacatgcgccaacatgcaagactggtgggcaagactccaggccttggaagtggttattttggaagagtacactgatgtcatttaattgtacataatcaactgaagtctcatctcagcagaccagagttagccctgacatctcatctgagccttttcacaatgtttaaatagtatttttgttaacatattgagccctggttttcagaactatattatggtgaattctgttctggaacctactggaaagcattggcaatgtccttccaccaagaaggaaaagtgggactcagtggggctctgtgtctgctctaggcctcggcagaggagagcacagtcgtttggagaggagacttggtacaaataaatgtcaccctccccaaaccattaacagtcatatcctcaacaattcccccaacactttgcagcttgcaaagcctttttctcaatggttatttcagctaatcttcacaacagcctcgagaatgagtagacgttattgttcagtcaattttatagatgatgcaactgaagatcaaggatgttggctgattcaatcaaggtgactcagccagggagcactagagctggcattcaaacttgtgaagctcagactcggagctccacaagcctcccttgccttgtccactgacttgcctcagcctaaatgtcacttctgcagagagctctttgtgactgccaaacccacgttaggtcccctttccatgattctcattaaaatggcaccaggtctttttaattcatagtgacaaaaattcataatttttgtcacagtggtcatctacttaccttgtgatgacttagttaatgcctgatttccaccctaaactgtgaccaccatggggaaaggatctggtctctctggtccaatgctgtgtatcccagtggggcatagtgtctggaacaccgagagcactcagaaaatatttgtgtaatgagtgatggtagcccctgctcttctctgaacttcaatgtccctaacagtggaacaaggtggttggacttcctgagggtccttctaaatcttttatgctgtgacccagagggtctccctaacttaggactttatga

SEQ ID NO: 8072 - DNA, 1527 bp, mus musculus; identical to SEQ ID NO: 8071

SEQ ID NO: 8073 - DNA, 1527 bp, mus musculus; identical to SEQ ID NO: 8071

SEQ ID NO: 8074 - DNA, 131 bp, mus musculus
ctcgcttccggaagtggcttctgcgacaacatgcttgcggacctcggcttaatcggaaccataggcgaggatgacgaggtgccggtggagcccgagtctgactccggggacgaggaagaggaggtatgagc

SEQ ID NO: 8075 - DNA, 230 bp, mus musculus
tctctggtgtttgcagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcggtaagacccc

SEQ ID NO: 8076 - DNA, 773 bp, mus musculus
taatgactcaaaacagtgacaaacatttatcctgtgcacaagtctgtaatttgaatagggctccgtggagaagacttgaatccactccacatagcattggttgtggggattgacttagggctggaggatctaaatcctctatgctcactcccatggctggtgaattgatgttggcaatcagctaggagtccagggggctttggctcctctttacgtggcctgggcttccttacaacatgatggttggattccaggggcaaatgttctaaactagctgaaagccatgttgccgtgtatgacttagctttagaaggcacatagcattacttatgctgtattctattatttgatgcagacaaaaagccccatccaggttcaagcgactccacatcttaacgggggagtgagaagttctggaagagcatgtaggacaggaaatactattgtgaccctttttagaaattataatctgtcacagctagaaaggaagagaacgcctcccaaaacactgcatgtccctggtgtcttgtgttttgtgcaagaaatcagcaggacatattccacgactagtccagaatgacaagtggtaagaattgagaaatgggggtcaactgaggtgaaggggaaatatgttgtttttactaacagaaatgtctaaagagttaatgatacttcaggtcatttttcaatagactgtaggtatgtgaaacagtggaagtgttccattatgaaaagcttaatcgagatagccaatggaagtattgaaaggtcat

SEQ ID NO: 8077 - DNA, 876 bp, mus musculus
tccctacagataattactatgttataaccagcttgcaaaatcaggactgacccccacctaaagttcagatggcaaggttgatgaaatcacaagcacacaaagagggtatggaaaggatgcttacttacataattgaggtctctgggagaaccgggcagacctctcaagcaggtcagaaatggtttgtgagggccaggaaaggtgactggcttgggtctctattatgattcaccgtgggaccagggtgagcattccatatgggcagaggtttccatggtttggatgtctcgctggtgccaaaggagaaagcacccaggctttttcttttcttttttttttgagcttgtacagatgtggctacaagggaaagcagaggggtgaggcttaaaatctatcaacagtcagacatcaaaaaatagaatcagactcctaattacagagcatttgttgacagttcttcatagctgtcattttgcttccatcatgttaaatattttgtagtccactcggtaaatgcttctagattaactgtttgtttggatcacaaatcttattttttgtctaatgtcaagaggaaactctaaaagtgtaagatctttgtaagggcattaagctcaatcacaaaagtgcaatgcttttagaaaactaagccgacactggttgagtccatctagctctagcctgctagagctgccagcactctcccccagttgtctgaaatatgccttcttctgtaattggccttgcacctctgctccaaaggaaggttcagttctgtctactcattgccttctaagtcttacttcctttggcaatatctaaggttaggtcagcagcgtgttttctattgtattaggtgatctcatcccctaggac

SEQ ID NO: 8078 - DNA, 1461 bp, mus musculus
gtggaagcttgcggcttttcattttctgcctctttttgggtattgttgctttccttttcactttgctctaataaggaatgttctctctagagcaaaataaatgccaatcttatgcgtttctgaagggagagctattgtggttggaaactactgaataattctcagagtattattttgtcattattactcaacctttactatcatattcctgatgttggctgggacctcctggtcctctgaggcacatagacaaggtcagggccagctcccatcacgtcccatactcggaaaggaaaaacctgcactgaaacttctcctctcctccagtgggcagcagggtgagcggtgactcagaaggtgggagctcattctcatggcttctttgcatcccaggggacacctgccttgcctgtgggctattttgccccatgttgaaccagatggaaaaaatctttttctttacaaatcataaatttgccctgttcacatacaatgtatgtgaatacagaaaccttaaaaaaaaaaaaaaaggctgggtgtggtggctcacgcctgtaatcccagcactttgggaggctgaggtgggcggatcatgaggtcaggagatcgagaccatcctggctaacacagtaaaaccccatctctacaaaaatacggaaaaaaaaaaaaaaattagccgggcgtggtggcgggcgcctgtagtcccagctacttgggaggctgaggcaggagaatggcgtgaacccgaggggcggagcttgcagtgagctgagattgcaccactgcactctggcctgggtgacagagtgagactccatctcaaaaaaaaaaaaaaaaatagagataagaatgatgaggatgaggggggaaaacttgtactggaataaagagagaaaaaaagaagttcatgtagaatagtcaggtaatgctgttaaaatgccctttgaccaccccactccttcgccagggagtttctctgattcactcgatatttcttgctcctccgtcagattgttcctaaaactccaaactctcagggtatttgcaacctctgcaaggtccacgctctaacctaacaacaaatccatgaagacacagcaggcagcaaggcatcccttcaatggggcgtgcaccccttcaagagcagttgaagttacaagaggaatcttttatttctgttatgttttcaacaatcacatttactggttaattagtgaggtgagcgtatgtcctggcttatgccagttgttctagtgtgattattaagaatgcctgtgggcactgtccaattgtcccactttcgatcatgaattaaatggtcactccatatacttgctttactcattgcttatctggagtggcactatacaatagatatataatagaagccaaatgtgtaatttaaatttttctggtagtcctattaaaacaaaaggaaaaaggtaaaattacttttaataa

SEQ ID NO: 8079 - DNA, 1276 bp, mus musculus
tggatatgggtactttgagagattcctgtgagcaaacccccgggacgtgcttcctgcacagaaacctcgaaacccctcctttgagctgttggtttaggatgaggagtgtgctgtctgccttcctctccctcagccgacccactgtgtgctgagtggggtcatggtcctgcctccttatttcccgaggcaccaagccttgtgccctgcacacagcacccacatcagtcaggctatgcccgcaggcctgacactgacctccacgaggggctcagggtccggcatggccatttctttgccatatccccaatgcctagtagagggcctggggcagagcgaacatttcataaatattggttgaatgaaagctgaataaactataagcttcccatcacctccctcctaattatttttgatgtctaaatgaggacaatttaaatatcagcattattctgctaattagtaaaacctaaaatccagtcccttgtaaagagatatccccgtattttacacagagagggtcaaatgcacggcccttccctggttttctattgcaaacctcacatttgtcttgcgaacacatttgcctgtttttgaaggctgggtgctggaagcttcaggcaacagtgatcccggccagggtctcagacagtaattcccacccagggaacagtcgctttaatgcgggggggaaggagaggagacctgcatgagccacggaaaccgttccctctacagggagccgtcatgcggcatgctcaccgtcagtttcagcccagggtgacgggggggtttactccgtgattcaccggcttttgggttccagagcacctcagatagaacaggggtctctaatcacagtgtgccacagcattcacgtccttatgcttgtcagagggtcaggttgggaagccggaatgtggagagagccaggcagagtttcccagaatcagccagcaaagacacatgcccgcatttcactccctggcagcctgagttcgttaactcatgggaagtttcggtgtcagtgacttctcatcttggctttcttttaataaataaacaatgaactcacacatcaccacagaaagcccctcttaaacctggcgaggtatttattctgtgtcgttggctcacttccctaggagtttgggggtggggggtggactacgaggtcactcatttgtcagctacgccgaccccgaattctgtggccatgcgcctgtgtgcgtgctctccaccttccctgtcccgggagaacctatggtgagaggccaca

SEQ ID NO: 8080 - DNA, 3329 bp, mus musculus
cagctaaaacatgaaatcaactaactctcaggacagtacttttaactcatgactgaagccactctgcctataaaaaaatctgttcccaccaggaacaaacattttcttcaccaactacatttcccagtgattgtttgcaatggtataagaacaaaatacagttgtatgagtggcagaattattgccttctttcatttccattttgacactgacaagagtatctgtgatgtaccctaaatcataaagctctgctatacatacattcatataaaatgaaacagattgggtattatcaagacattgataaaatgtatattaaaattgaaagcatgtgctgttttgctactggaacactgaaaaacaaacattggacctgtgtgagtttataaaaaataagcaaaaattgcacagagttcaattatttttaaaaataagaatactgaaagataaggtttcctcaaagattagtgttatttacatgtatccaatatttggaatgcacagtgtaatacatttggcatggctatagttagaaacgtggagaaaatatttgctgtccataaactctcatttggttaaatggagaaatacaatatccttctttatttgttgtccgtgggtaattcttcagtgcatacagttacataaaaatcctaagtttttaaaattggttttgtctgaaattatacataggcaatcctcactttgcatggttctgatatttacaaaatttacttactactgttagttcattaaaatcagtccccacaaaacatggttgaaatttgtcatcaaggtgtattaatccatttttatactgctataaaaaaactgcctgaaacttggaaatttataaagaaaaaagctttaattgactcatagttctgcatggctagggaagcctcaggaaacttacaatcatggtggaagtcacctcttcacaaggcagcaagagtgagaatgagtgccaagcgaagggggaagccccttataaaaccatcagattttctgagaattcactcactatcatgagaacagtatgtgggaaatgacccccttgattcaattatctctacctggccttgcccttgacacacaggtattattacaactcaggatgaaatttgggtggacacacagccaatcacatcattccacccctggctcctcccaaatctcatgtcctcacatttcaaaacacaattatgccttcccgacagtcccctaaagtcttaactcattccagccttaaaccaaaagcccaagtccaaagtttcatctgagacaaggcaagtcccttctgcctatgagcctgtaaaatcagaagaaagttagtttcttcctagatacaatagctatacaggcattaggtaaatatagacttccaaatgagataaattggccaaaacaaaggggctacaggccccatccaagtccgaaatccaatagggcagtcattaaaccttaaatttataaaatgatctcctttgacgccatatctcacatccaggaaacacttatgcaagaggtaggctcccacaaccttgggcagctctgcctttgtggctttgcagggtacagctcccttcccagctgctttcatggctggcattgagtgtttgcagctcttccagggcacagtgcaagctatctgtggatctaccattctggggtctggaaaaaggttgccctcttctcatagctcctctagccaatgctccagtagggactctgtgagggagctgtcaccccacatttcccttccacactgccttagcagaggatctccatgagggttccacccctgcagcacacccctgcctggacatccaggtgtttaccatacatcctctgaaatctaggcagaggttcccaaacctcaattctcgtcttctacacacaccagaccaacaacacatggaagttgccaaggcttggggcttgcaccctctgaagccacagcctgagctgtaggttggccccttttagccatggctggaatggctgggatgcaggacaccaagtcccaaggctgcacacagtaatggggccctggggctggcccagaaaaccgattttctcttctacatctcagggtctgggatggaggtctctgatatgccctggagactttttccccattgtcttagtgattagcatttggctccttgttacttctgccaatttctccagccagcttgaatttcttcccacaaaacgggtttttcttttctactgcattgtcagcctgcaaatttttcaaacttttattctctgtcacctcttgaatgcttttctgcttagaaatttcttccaccagataccctaaatcatctttcccaaattcaaagttccacagatctctaggagaggggcaaaataccaccagtctctttgcatagcaagagtgacctttactccagttcccaacaagttcctcatctccctctgagaccaactcatcctggatttcattgtccatatcactaacagcattttggtcaaagccattcaacaagtctctaggaagttccaaacttttccacattttcctgtcttcttctgagccctcaaaactgttccaacctctgcctgttaacccagctctaaagttgcttccatatttttgggtatctttatagaagcaccccactctctgtggtaccaatttacggtattagttcattttcatattgctataaagaactgcctgagtataggtaatttataaagaaaagaggtttaattgactcacagttctgcatggctggggggcctcaggaaacttacaatcatggcagaaggaacctctttacagggcgtcaggagagagaatgagtgccgaaggaaggggcaattctcttataaaaccatcagatctcgtgagaactcactcactatcatgagagcaatatacgggaaaggactcgggtgattcaattatcttcacgtggtcccacccttgacagctgggggttgttacaattccagatgagatttgggtggagacacagccaaaccatatcacaaggtgtattaactgtagttaattgtataaagtaaaaacttcactgctagcgcttctgtccacaagtcactccataaataacctattcctcatgatcactgatgatcagacacttcatagtctgatggtgacaggccactgaggatcttttattcagttcattcaaacagcaagcatgtagttgtgttgcctttatgtctcccactgatacatccaagtgacatttcacaaaaatgcataattggaagagggaaatggccaaagataagagttctgcaaagtaaaataaaaatgataaccc

SEQ ID NO: 8081 - DNA, 808 bp, mus musculus
atatatgctgatgaggtatgctttacatacttagaaaacatgatttgtatagatatttggcacataatggaaagggttgaggaaaaggacaccatgccgtaccacacagcacaaactggagcatcttgctctgtgaggtgggtccagatacactgtctagcaatggaaggggacaagcgcaaggggttgtactttataaaactggaatcacacagtctttcatacttaccttcggttggaaataagaccaggcagtgaatgctataggttaatacatatgttcctcactgatcctcttcctttgagggatgaggttgacaacagcctgtattatgatgacatgactcacctacaactagattctgttatgagggatggcaagggagttttgctttatgtgaggtgaaaaagaatttttttctcctactagggagaacggcaagcattggaacattccggtagtaaaagggcattgatagttttctttctatatatttttcacatgagataatactgcccagcaccctgccacacctccccagtgtttcttcagcttctctctgaatgtggataagctcttaaaggagtgatctttccagtggttctttctgtgggaggtaaaatggcaggtgaacatgggccttgttatatgtagggcagagcaaatagctacaactaaggaaaccacccagcaccttccccagaagagtattagccagagtaacacagtgatctctcttgagatcttctccactggcagctggaaagtttttgcaaggattcctgtttctggtctgattcctatgtt

SEQ ID NO: 8082 - DNA, 2520 bp, mus musculus
ttttaaaaaccaatttcctggtaagatctgaaaagctcattctgactaaagtgataccccacaatgggtacaactttgaaggatatctgcgttttaatcaggtttcaattctcccagcagtagcatctataggcgctggatcctatcagggtcctgcagtcactcgttgttaaatattttgaatatcagccctaatttgaatagtgcacagtcttaaataaaaggaagcaaggcaacattttatttttcatctagatccattctcagtctattctgcatgcacatacagtacaaccaatatttctatcctaacacagttcttgatgatcaactgccttttctataatcaaaacatatgagcaaatagtgactttagaaacaacacagcatgctgagtttgtcttcatgctatgcataggttgcattattcaacatttgtgttatcaatgcatgatacaacatgtagaatgatttatctgtagtaagtaatttagaagggactccaattttccatttggtgcaattcatttcttcacatgtccaggccctgctttagatgttgggaggacaaagctgagcaaatcatttatattccattcaaggatcttagagtttcttgaaactatcacagcccaatgttctttctacacaattagtttgttagaaatgatggagaatctagagggtaaggatagtttaaccttttcaggatgcataaaaacaattgactatgaccctgtctctacaaaaaaaaaaaaatgtgcctatcctggtggcacatgactgtagtttcagctacttgggaaattgaggcaggaggatagctatggcccaggaatttgaggccacaatgagctatgatcacaccactgtactccaacctgggcaacagagtaagacgctgtctcagaaaagtaataataattggttatgaattcaagaaaactacaaagaataatgcaatcataagctatcaagagacgttaaagtaacagcattctatcatatatggtgaagtgcctatgtagttcatgggaataagtgggtagcccacaggatacctgttgttgtccatgaaggactagaactccctgatatgggggaacccgccaccgataattcaacgtgtgttattttctatttgtctaagtgtcagccagtctgacaaataaagggaaagagtacacaagagagaaattttaaagctgggtatctgtgggagacatcacacgtcagcaggttttgtgatgcccccgagccacaaacccagcaggtttttattagcaattttcaaagaggagggagtgcacgaatagggtgtgggtcacagagatcacatgcttcaagggcgacaaaagatcacaaggcagaagttaagggtgaaactagaatcactaatgaacttccatgtcctgatgtgcatgcattgtcacggttcaagagcagagaaccagtctgactagaattcaccaggctggaatttcctaatcctagcaagcctgggggcactgcaggagactagggcatgtttcatccctatccatagctacataaggcagacactcctagggtggccattttagaggccccgccctgggaatgcgttcttttcccagggctgttaattattaatattccttactggggaaagaattcagcgatatttctcttatccatttttggtaataagagaaatatggctccatcatgcccggcccacaggcagccagactttaaggttatctcccttgttcccagaaaattgctgttatcctgttcttaaggtgcccagatttgatattgttcaaacacacatgctctacaaacaatttgtgcagttaacacaatcatcacagggttctgaggcgacatacatcctcaccttatgaagatgacaggattaagagattaaagtaaagacaggcataggaaatcacaagaatattgattggggaagtgataagtgtctatgaaatcttcacaatttatgttcagagattgcagtaaagacaggccaggtgtaagaaattataaaagtattaatttggggaactaataaatgtccatgaaatcttcacaatttatgttcttctgccatggcttcagccggtccctccgttcggggtccctgacttcctgcatcacctagaactagagctctcttaagataccacttaccaagttgcaaatcctgtgctgaacttgttttgatttcaaatgtcttatacttactggacaaatgttactatgaattctgctaaccaattatctgcttcactttagaaggaaaaactgtgaatgacaaaatctggcaggaacacagcaagcataagaatgattcccacatcagaaggccctgtcagctaaaaggtaattgctaaatttagttcagctgactttgcattttcccaaagtagtttaaagggcaggtaagaaaaattcacatcttccaccatgaaaataagcagaccattatggtctacttaaaaaggaaaaccaaataagatagaatagaatatg

SEQ ID NO: 8083 - DNA, 340 bp, mus musculus
aagggattagtgttcactccctggaaaacaaaagccaatagtctaagcagccaggtccattctttaggtggacctgggttgggaaagtaggttggagacgagctgacctcaccagtgtgcaaactgtcctgacagttccttgtgagtactccgaggcatagatagctctcattacatgcagtgttgtagaaagccacatcaatcctgaattggatactgaacacagaaattagagtgaagtccacagaatatataaatgcagtctgcaacctgcagagtgattgctacccttgcattcattctgaaagccatccttgagactgcatataaacatattctg

SEQ ID NO: 8084 - DNA, 589 bp, mus musculus
aatatttttctcattagagaccatcaagtcatgcaaagtaagtactttccaagtttaaatgacaatggtcaatctatttactcctttgacattatgaagaagatcatgatcgtcactaacacctatgtaatagatacccatagggccccatctcacactcttacaacccatctttttactgcagacattgctataaaatcaggtccatgcatttgtaaactgacagcagctgcttcagctgcctcctgtatctctcattttcatccctgaggcttttttgccaccacctcatgggactcctttaagaacctgctaagccattctgactcacgcacaaatcaaaggagtgaggaagctaacactacaaggacaatccttgaccaatggaaaaagaaggagagtagtgaataaacactaccctcagtcatctctaagctggacagttctgagtttcatttgacacaggaccccaagggtatctggtaggactgagctccagttgtccacagtagtgattagatgaataaagcaccctgggattggttttctcccttcccctgcttcactttccagtccctagtactgtttc

SEQ ID NO: 8085 - DNA, 266 bp, mus musculus
gaaaaaagagaaacagaatatgatctacatctactgcttgccatatgtctccacatttcccctgatttttggatagtaagctaaatctaataagaagagcacaaagaggtaaatgacaaaggtgagctaaagcatttggcagcatttaaacaacataatacaggctgtacttacatctgcctttgtgaagataaaaggatgttgtactggaaaaccattctaattttagtaactacctctataaaactgcaagcaaataatttgca

SEQ ID NO: 8086 - DNA, 193 bp, mus musculus
gtctacttttaaacagcaattctcttttatgtaaattaactaagagttcatttagaaatgatatttccccttataagtattcattttgtcagcttaagtaagagccaaatgatctcagatcagattcaatagggaaactgctgaagggaaaataagagaatcatgaaagagaatagaaaatcaatacatagca

SEQ ID NO: 8087 - DNA, 626 bp, mus musculus
tttgttattcctggaaatttgacattttttgatgacagaataaggggaaataacatttttaaatatatatagcacgtttgttgctagaatatggaaatacaaataactggtttacttatgtagttttccaggtttctggtgactttattaaactcttcttaattataagtgtttgtcattaaaattctagattttctacaataaattggtgtcatccacaattaattgctatattaactttttctttctaattgtttgcctttgttttcttcatattttatagtatgaattccagtaaaaccttgaacagaagtggtgatggcaggtatgttttttcctcatttctaatttccaaagaatacatgcaatttaaaaaaaatgaattatgtattgtttttctttatttatatgtgtgtgcatatgtgcatgtgtgttttttcacaacttaagagagtttccttctatcccagtttgctaagagtttatgtcataaatatatgttgaatttcatctttaatatttctgtatctatataaaattatacatttttcactattttgttaatgaagggggattgatttttcaaatattaagacatttttataactgaaataagccctagttga

SEQ ID NO: 8088 - DNA, 1039 bp, mus musculus
cgtttggtccagcagggggtggtagaactccattttaagcccagaagttggtttctgctcttccacagagtccttctatcattcttcagcagggcttgacattttggatgtgaagccttcctttttctgcccttctcctccccacagctatagtgttagtggcggatgaaacacgattggatgcagatttaatgttcagaaatcagtatgcaaatgttggatattcctatagtttgtaaagtgtcttgataagattctgctcattttcccttcctaacatagagtatgaaatatttcagtcttagcaaaattgcagatatgtccatctgaagctaatactagcccaattcgttaattcagtggttcttaagcaaagatcagcatgcacatatgtcctacagatatgcttctttaattttcagatagctgctgattgtgtttaactgttcatttatagcatagacaggtatttttgagcaccaagaaacaatccctgaaaattgcagttaaaatacaactgcaattaaataagtgtaggtagtgtggggcagaatgggagcataataggaaacaagtttatgcagacttaggattacattgtgagtggtttggagaagaaaaatgtctcagttgtggaatctgaatttatcattgtagaggctaagtgtgttggaatttggagacataggaaattagaaatgtttagatatataggtttaaatagtacacagagacataaaatttggatgtgtacatgtaacatagatgtgaaattgtgattcagctaatttgtaagtcaggatacgaggtggttatgaagaggcactctgagacaagcatctctgaaggggagcccatattcactgtaatgaaacagggtagaaggagaccatcattgtaaagatctctctatctagtacaatttcacaatgtgtggcactcatagagacacagatatatatcagagagacgtagcttttgtgaaagggaacatatagtacttctatgccatgtgtcctgatgaagtcagagatgcttg

SEQ ID NO: 8089 - DNA, 4238 bp, mus musculus
gctgtttttacttggctttgtggaagaaacttgtcttcagcaactcaaagcatcacatacttatgcacttacctgaagttgggaaataaagaaatataggcgcagtttattttattgtgtttccttttattgcatttcacagatactgcattttttttacaactcgaatgtctgtggcccccctgtgtcaagcaaatctatcggcctcatttttctgatagcatatgctctccttgggtctctgtgtcacatttaggtaactggcaatatttcaaacattttattattattatgtctttatggtgatctgttatcattgatcgttgatgttacaattgtaattatcttagggtacctcaaagcatacccacataatgacaaacttaatcaatttataagtgtcgtgtatactctgactgctccactgactggctgtttcctggtatttgtccctctcttcagaccttccattccctgagacacaacaatattgaaattaggccaataaattaaccctacaatggcccctaaatattcaagtcaaaagacgggtcacaggtctctcccttaaaatcaaaagttagaaataattaagtttagtgaggaaggcatattgaaagccaaaataggccaaaagctaggcctcctgtgccggttaaccaaattatgaatgcagaaaacacaattactgaaggaaattaaaaaagccactccagtgaatacacaaataagaaagcaaagcaaccttattgcttatatggagaaagttttactggtttggatagaagagcaaactagccacaatattctcttaaaccaaagcgtaatccagagaaaggtcctaatactccagttctgtggaggctgaattggagaggtgaggcgagacaggtgaggaagctacagaagaaaagttggaagcaagcataaattagttcacgagggccggacgtggtggctcacacctgtaatttcagcacttttggaggctgaagtgggcagatcatttgaggtcaggagttcgagaccagcctgaccaacatggtgaaaccccgcctctactaaaaatacaaaattagtggagcatggtggtgcatgcctgtaatcccagctacttgggaggctgaggcaggagaattgcttgaaacctggaggcggaggttgcagtgagctgggattgtgccattgcactctagtctgggcaaaaagagtgaaactgcatctcaaaaaaaaaaaaagaaaataaaaaagaaattggttcatgaggtttaaagaaagaagccatctccataacataaaagtgcaaggtgaagcagcagatgctgatggagaagctacagcaagttattcagaaattctagttaacatagttgatgaaggcaggactacactaaacaacagaattttaatatagaagaaacagccttctattgtcagatgatactatctagaagtttcttagctagagaagagaagtcaatgcttggcttcaaagttgcaaaggacaggctggctttcttcttagggaataatacagctggtgactaagctgaaggcaatgcccatttgctattcttatagtcctagcgtccttaagaattacgctaagtcgtaatcccagcactttgggaggccgaggaaggcagatcatgaggtcaagagatcgagaccatcctggccaacatgatgaaaccccatctctactaaaaatacaaaaattagctggacgtggtggtgcacacctgtagttccagctactctggaggctgaggcagaagaatagcttgaacctgggaggcggaggttgcagtaggccgagatcgtgctattgcactccagcctgggcaatggagtgagactccatctcaaaaaaaaaaaaaaaaaattatgccaaatctattctgactgtgctctacaaatgaaacaaaaagctgggatgacagcacatctgtttacaacatgatttactgaatattgtaagctcactgtagggacctacttctcagaaaagaaaaaagttcccttcaaaatattactgctaattgacaatgcctctgctcaatcaagagctgtcgtggagatttacaaaaagatcaacattgtttttatgcctactaacacaacattcattctgtagctcagggatcaaggagtaattttgactcttgctcttattctttaagaaatatatttcataaggctatagctgccatcggtaatgattcctctaatggatctgggcaaagtcaattgaaaaccttctggaaattcaccattctagatgccattaagaacatttgtggttcatgggaggaggtcacatgtcaacattaataggagtttggaagttattcctcgtatttctccatcctcatggatggccgaggttcaagacttcggcagaagtagtaactgcagatctgatggaaagaggaagagaaatagattagaagtggagcttgcagatgggactgaaattctgcaatctcatgacaaaacttgaatggatgagaagttattagcttcttatgggtaagcaaggaaagtgatttcttgagatggaatctaattctggtgaagatgttctgaaccttattgaaatataaacattatttagaatattacatacacttagttaataaaacagtcagagggtttgagaagactgacttcaattttgaaaagcattctattgtaggtcaaacacgatcaaacaatattgcatgctacagagaagtacgttaggaaaggaagagccgattgaaaacaccggacatcattgttgtgttattttgagaaattgccacagtcacttcaaccttgagcaaacccctaccctgatcaggaagtaaccatttacatggaggcaagaccctctaccagctaaaggattaggacccactgaaggcttagatgatccttcactcttttttagcaataaaacatttttaaattaatgtatggacatttttagacatcattctgttgcacacttaatagactagtataaatacaacttttacatgccctggaaaaccaaaaaaaattgtgttacttagtttattgtgatatatgctttattgtattctggactcaaactggcgatatctccaaggtatgcctgtatttctgttttgtttgtttgtttgtttttggttttttttgagacaaagtctcgctcttgtcccccaggctggagcgcaatggcacgatctcggctcactgcaacctccgcctctcgcgttcaagcaattctcctgccgtagcctcctgagtagctgggattacaggcgcctgccaccatgcctggctaattttttttttgtatttttagtagagacagggtttcaccatgttggccagctggtcttgaactcctgacctcaggtaatccgcccacttcggcctcccaaaatgctggcattacagacgtgagccacaatgcccagtcgcctgtatttctttagttgattttctttggaggaaaaatccccttaccctgtgttgtctagccaacttccctcaatactcattggctataatcatttcatatgatcactcctaaattaattggtggtgaggagaatgacattaacatgatttcctttcccgaatcaactcccttttgctgatgggaagatctgcctccctcgaagtacatgactggccaatcaaatgacgtgtccatcttgcaaggaagaatgaaggatcgagaatattgtagtcaaatatgtctgccgcaggaatgttgaaaagaccatttttgacaaagaatgcaaacaatatcaaagccaacgtttataaagttcttacagtgtaccatatttatgcgcttcgtatgtgtgatctcatatgattctccaaacttttgagattaattatcttttataaatgaggtaatgagattttaaagagtttagatgacttgcctaactgacaacactgtcagtggcaaagttgggatttgaactcagtctgatgggcaaaaagagttgtcttctaccagccaagttgccataaaagaaaactatgcattgtgcatagttttactcttgttaagtgtaagaatgataaggtaaggctattaacttgctttgtgaacaggctatgttctgggcactttccaaaaaaaaagctgttatgcttgagcttctttaatacctatatctgcttatatattattattatttaaaaaggttttacaaataaggaaattatgggacagagtgataagtaat

SEQ ID NO: 8090 - DNA, 653 bp, mus musculus
ttggagaatgaggatcaaacatcagatccatttagtatttgttaaatttgaaatatcaaatcgttggttagatatgtgggcgtatggaaatgagaagataaccatggcttggaaacatacaccatgatgctgtcagtgttaacaggtgaatggtatgtgagtgagggtaaacccgtctaagcaatgcctaaaatatctgaagaggggttgatgtctgtagtactcatttgtgtttgccagtaactagaagggcgactggcacagcagtgatttccagagaatatttcttgaattactgaagagtagaaagaagttaagaactgagttccaaggaactatcatattatactagaagaagaaaccagatcactccacccctcatcatgagactaacactttacaaacttactggaaaaacaggagcgtagtatcttggaagttaacaaagggtcatatttcaagaagaatagatgtaaagtgtcaaatgctgctgaaaggtcaatggaactgaaccagaacagatgtgaagtatccctatcacgtgcagctttgctgacgtcattgagagataaattaggtacaagtgggcagagaattgtatgtgaggttagggagtttagactccatatttatttaatgctttcaggaagttt

SEQ ID NO: 8091 - DNA, 605 bp, mus musculus
tctcatgtcttatgatgtagattaatctttctctttatatatacctgatacatgtttcctgagtaaacttacagagattatttacgctctggtgtatgttgccacacacgggtgtaggaaaatattcttgatcactctattattttgttaatgattataatataaatggtcattaactttggtaccgaacactaggttaatgatgttcagatattccttttatagttccagttcaaagtctagtttataagaaaagagttttaacataaacaaggtcattgaagtcagtgcttcttggtgatgaaattgagattaaatcatgctatttacacatcaaaagcctgattaacataaaatgcctgtaacaattacacagcccaggcacacagatcaactcatgaatcaacataaactacttttatcagaaccactaacattttaggagttgtgaatttatcactgatttacttttttaagaaatttcaagtatgacagtcaaaaacccttaaatttctaatttacaaggcagttgaacatagtcactagaaattaagagcaaatgcatcaaacttctctgtctaccacaaatacattcttcttccttt

SEQ ID NO: 8092 - DNA, 692 bp, mus musculus
taatatatataattattaaaataaaaaatccaattttaaaatatgatttataattttttaactgtacttcaaaatatcacagaatggagcgacaggcaaaggaaagagggggaagagaaagagacagaggaagaaacagattaagaaaaaaaatctaaggatcaatattctagttccaagaaaaataatgtaactgtacaatatgcatttaaagttgaaggcacaaaagcttgattcacagctttcctactattcttctttttggagccattccaaatgtcattattaaagtggctatttacatatagtgtcataacatggtaagctaaaggctaaagttgatagtagaaagaacttcattaaaaaggctatattttaaaaataagaaagtctttttacaagtaatgttaaatgggaaattaaggcaatgacccaaataattaaagtaaaacaaatcctaagcatctgagggaaaaatggaagtttgaggtttaaatcatcacaaattactgtctacattcatcaaattaatggggcaattactcagcatgcactttaaataggttacgtatcttcaaattgaagtcatttctatatggaaagactgatttactgactttgcttttttctttttctcaaagtgtcagtgattgatttcttttaataaaatgaactaattctaatattgacag

SEQ ID NO: 8093 - DNA, 1073 bp, mus musculus
taaaatatgttatttctagatatatttgaaagttaaaggaaaatggtcctcttattaaagttaaactttggttgttaaagaagtagataaaagtaaaagaaagtaaaattctagcttcttgaattttagtctaagtggaatagaagtacccaaagttctcatcttgataaaatagagttcctctgttacattttcacggtcaacaaatttacaatgttgaagtggaatatcaaaatgcttttagcaatacccacagatgtgagacattataatagagctttgcttaggatagcaatgccaacagatatgtaaatgtataatttttggccttggcacaggaaaaatgactgacgaaatttttgaaatattttccattacagcatatctgttggggtagaatggtttgggtttacttaatttcacagccttttcatagtaagaagaatggccataatttttagaactgtagggcctcaaacatgagtcagatgattttaggtaacaatttttaccatagtggaataaatttattttattaaaaatatggtaatcttataaattatgatacaagatattttgatatccagaatttgtacttcccaaatcatctttgaaagtaattgtgcaaagaaaacttatttcaggccaggcgtggtggctcacgcctgaaatcccagcggaggccgaggtgggtggatcgcgaggtcaagagatcaagaacatcctggccaacatggggaaaccccgtctctactaaaaacacaaaaattagctgggtgtggtggcatgcctgcagtcccagctacttgggaggctgaggcaggagaatcgtttgaacccaggaggcagaggttgcagtgagctgagatcatgccactgtactccagcctgggcgacagggtgagactccatctcaaaaaaaaataaaaataaaaacctatttcagagagcatacttaagttactagagtttcaattcaagaaataacatagggttttaaaaacatcttttaatagagaatataaaaatcattttgattgaaaatttaacctattagatttttcaaatagata

SEQ ID NO: 8094 - DNA, 1612 bp, mus musculus
ttaaaatttactttacatcaatgtttgtataccatttaaaattgcacattttaaaacatctgtttcaattaggctgtctcttattaccatatttgctgcagctgtttctatcattgactgactgatactagaagtttatttggcttaattttccaattttttttttgtattttaggatgaaatgcatttttaaacatttagattagggcaaacattttcccattattttctttgtatctttgttagtttattctttgcttgaaaggaagtaagtagtgttgagacaagtttataaggaaacactaattatgagtggagacatatggaaagggtttttacatgctcagttgaaggcagaggactcggctgtgtcttccagcactggacaatgtcactactgtcaggaatctgaaagcagagtacttcacgcacgaagccgaaaaatggaagctatgttcttcctcattagacaatactcactgccccatgcctcccccacatcttttctaaaagttttattttctatatgcttgtttagaaatacttcagaaagacctagacacagacgttgtcatataagctacagatttttttactttggataattgtgtcactttagacctaaaggagaagcaaatgaatcaatgtgttattcacagacttctaaatattctggtagttcattacattactcacatctttccaaaccataaaaaggattttgggatttttagccctttgttgcttgtatctattgaatatattatgacatgatttatttctttctatctatccatctatctatctatcatctatctacctagtgtcttgttattgaaccattacttaggccacataaaataaaaacatttggaataagtgagacatttagtagttttttcatatttgtaactttctactagaaacatccacaataagaaaatgtgtgtggcacttaaatgatgttgcttaataggctagagaactttaaatcaattttacatctaatatagttaagctcttcacatgaatactaagtgaattcttatgctctccactttgtgaaggaaaaaggctgaaattcagaaaattttacatgatctatattcccaaagtcacatacatactaaatgatggaagccaaacaggaaccttggtctttagacttaaaacatagcttcctttcctttcatgtgcaagtaatgaatatatcacatgtctatttttgtgtaattcactttatgtttctaattgtagcttgatcaatatgtatttttagttggtataagcatacaatgtcatagaacaaataagccccaatcttgaatagcagaatagggtgactatagtagtaacattgtataatttatttccaagtagttagaagagagggcttgaaatgttaccaacacatggtcatggttaccccaaatgacctgacttgatcattacatattctatgcttataacaaataccacgtgtaacccgtaaatatgtaaaatattttgcatcagtaaaaaaactgtatttgtcaataggcaaataatttttactctctagtgttcattcttttattcagatacaaaaaaatttggatcaatgattctctag

SEQ ID NO: 8095 - DNA, 303 bp, mus musculus
aaactgagtatgatagctttatattagcgaggcattggcataaaccagctttgcaaaaagaatgtcatcattaacggacagaataattaggcatctataaaatatattattagtgtcaaagtttactaatatccataaaattaaacttcattttactcaatatatttcactttagttattaaaagtgtattctaaaatacgtttaattaaatttattaaaattatgcttttaaaattaattcgaactttgaattaagatgtaatggatgtcttcagaaaaactgatcaagttttgaggtatta

SEQ ID NO: 8096 - DNA, 672 bp, mus musculus
tgctcccttggcatcaaataaaaataaaaacagattttaacttcaactttaatgtacttggcaaaaaactggaaaacaactgaatttaattaagcacaaatgcagtgattcgaagacattttagacatggagcatgaataaatccagcgattttgtaattttcagctcatgtgaacaatagctattataattcccatttaatagctgtaaacttagggatataaataattcaaattactttcttcaaacacagtctgtagaaaggagtaaaattgaaatgtagcagttgggattttagcaacgtctgatgtttgcttgatgtttatgaaagaagagaacaatacagggatcagtaatctcacagaggaaattaaggagaaaatagtaattaaaaaaaaacaatagtgtttctccattttacagtttacaaaatatttaacaagcaatgtatctacttgtaaataggaattaaaatttctgctattcactgactcagatactaaatagggtagttgttaaacatccccagagagaaacactaagttgtcagaaaaataaagacagatgtagagggaggcagtaatggtttttgatggtgcttacacactgagggcttcctgatatggaatgaaggacaacttacattgtggatggagtcctgggacctctctt

SEQ ID NO: 8097 - DNA, 49 bp, mus musculus
tgataagttgacagttaaataaaattctctaaaattgcttctaattgaa

SEQ ID NO: 8098 - DNA, 49 bp, mus musculus; identical to SEQ ID NO: 8097

SEQ ID NO: 8099 - DNA, 49 bp, mus musculus; identical to SEQ ID NO: 8097

SEQ ID NO: 8100 - DNA, 2343 bp, mus musculus
ggaaatgttcttacttgaagattcatgaggcacgtttgtatagtaaaggctttttgaaattctgcagcaaaacaaacaaacaaacactctgtttcttttgtctaacccagtgtctttcacattttaattattggaagacccttatttgaatcgtagctattaatgtcccactcaactcatgctccccagagcacacttgaggcaacatgggccagtaacaccactgcaatttcagcacacacatccaaagtcacatgaccatacatcctgcagctgcttcattctaagccagagtctgccattcccaatttcagaacattttcttaaaggtttaagattaccatgacacacggttacctatgtaaaaacctgcacatactgcccatgtacccggaacttaacataaaaatacaaattaataaaaaaaaacacttagtatggtggcagatattttgcatgcttaataaatattttttctttaaaaaaggtatacttagatgtttaatacttattgccctcttttatttagaaaatattcttaaaaccacataatctattctaaaggtttaccattttattagcataaaatttgatctggagccattttacttttctttttctcgtttttttttttacactagacttgctttttaacattgttttaaattgaaaattcatattagacttaaaatatcttttccaggaatgtaatttgtggtaaattaaaggtctatatttacaatttaacctattctttattttaaaatgcttatctgattttttaaatgacaaattttcatggcaacacaaaagcatccaaattaaaaggaatgtattccaactaaatcaactgtattaatttgttatcttgatttactactgagatcaagttgtatcaaattggaaactccctacttattatacagcactgtcactatttttccaagtaatttatttaaaataattaaattaattgtttgaaataataaagtaattagaaaaatagttaatcttggagaggaaaatttttaaaaaggaaagaagtaaaaatatttaatttataatctcagttatgaactactgaaaacattaaactctttagaataactttcccaagttacttggacaatattttacttttttcttattaaaaacttaggaatcttctaaagtacataatgaaatctaaggtaagattagtcacaaattgaaattaacaagcaatgatattgactaaataataagtaaactactggccacaaattaatctcatagaaacaccttccacagcttgaaaagattttcttttagcttttaaaaatattatttggcacatttgtcaagtagagcagttaaatttgaaagattaggccatgttgtgtcttttgattagttgccagtttactagtatcctggcaaagcaaacatacaaaataaagcaatcatacaacagcctatcaactgtattgaaaatttctacttattaatgtttcaagagaagtgtgataatgcagatttttatattagaattatgcctgtgtgttttcatttaacaaaaatccaatggttaattgttattattaccatcagttatcatcaatttggagactaagagttcactacaacttactatttccctttaaaaattcaaaaaaatattaaaacatattattttttacaccaaacgagtcaaagagcacagacaatcttaaggcaaaacacctattttatctaatgattgattaaaactcaacctatacatgggttggtacacacacacatgtatttccttgctctgtctgctgagagggcttaggaacaatgataccccagtaacaatgaacactcctggcacctagagctcctcagaaaaaatatatattattctggtgctgggaagggagatacataagatgattctggaggatcttatagtgctggaaagtaaagaaatgctcccatgagtgcatactgatatagataaatgattaaataaataagtagggagaataggcaaatctgctcagcagaagagccaggggatccaggttagcatcagcagtggtagattatgctgctagtattcacgcttgataacaggtgatgcaaagggtatgttacctatctggtcttcctccccaaagcctagagccctactctactaatgagaaaatatcagacaaattccaacagagtagcattctgcaaaatagctgaccaatattgaccaaaaccaccaaagtcatgaaaaacaaggaaaatctgaaaaactgtcacaaccaagataagcctaagaagattagtgagaaaaatgtaatgtgctatcctgaatgcaatcccgaa

SEQ ID NO: 8101 - DNA, 2343 bp, mus musculus; identical to SEQ ID NO: 8100

SEQ ID NO: 8102 - DNA, 1130 bp, mus musculus
acaatcagtccaaactataatgacaaacatgaaacatacctagttcacagcaggcacttcctgttgtttgctaaacattcagaaggtgtgagccctgccattctgtctttttgtgtttcacagggttttcactttcttctgtggaagaagatggtattcgaaggctgtacgtgaatagtgtgaaggaaaccggtttagcttccaagaaaggtaagtcagtgaaggagggctggtctgtctgtcttaaatgccctttggggcttctctagtttttgaaggagaaagatatgcccaaaggattcatttgtggaaagtatttgaacattttctcattgaaaacccttccagggaatatgcattttattccattaacttaagtgtaccagaaaggtcatattcttgaactttttttttctttttttaatttttagagacaaggtcttgctctatcacccaggctggagtccagtggcgcaatcataggtcactgtagcatcgaaatcctgggctcaagccaccctctcacctcagccccccaggtcgctaggggagtacaggtgcatgccaccacacctgactaatttatttacttatttatttttcagagtcaggggtcttgctgtgttgccccggctgttcttgagctcctgggctcaagcgatcctcctgtctcagcctctcaagtcactcatttttggattttaaactgattgagcccattaccctggggctggtgggaaattccattctaatcatgtggtcgtccttctccatcttctaggatggtgtggggatcctgggggggttcttcctggagcagagcatgggggaagacccctctgtactttggtccacactggtcaaagctgacattggctattgcctgagcctgcagagctctttcaaaccagttgttctgttgcttccgttcatagaagaatctgcgaaagttgagaacctagggatttgagatccagcctccctccccttctttagagagcgcttccccgctacatcctgcctgtttcattttagcccttaaatggcctataatgcatttgggctacttggggaaccccaactcttcatcctttttctacccctggaaagtctttgcaacctagatgatt

SEQ ID NO: 8103 - DNA, 2546 bp, mus musculus
ttggacaattctgttctctccagtcttagttgcctcatttgacatttgagtttaatgttgcctaggttatttctaagcagtatggcacagtggagaaagcaaggactctaattttgatcttggatcagccacctaccagctgagtgatcttggataacttagtttaaccactgtgtgctacaggttcttattagcaaaatgaggatgtttggtgatcattttatgcaaagcccttagaacagtgcctggaatataagcacctctcgatgttagctgttttgtttgttatctctaagattccttcgtgtgcaaagactcctcgagtctgtgttaaaacatgaaggaaggtgacttaatgacagctaatctagcttgcttgcaccctgtgtcagacttgcaatttctagaaattaccatcagagataatttaactatcaggaccctatttgtactcccttgatgatgtcaccagagggaaagatttcaatgccttccaggccatgccagtgctcatacccactagggtggtactagctgggggaagtggtccatcagccaatgctgtgctcagagttgtttttatagttgctggtagaacttgcagaagggaaccgtgactctctcccccatctcccatgccttcagttcaacagaaaggacctggaagtcaatatcccttgcactggcattaagagatacaactctggctttgccacctgctctctacttccgcctgagcactgctccagctgcacagagcttgctccgagctccaggctcctgctaagctagcaccaccgtcgactccctccagctgccttcatgattacctaccgagatctcatcagccacaaagaggtatcctctgacttttacaaagatcctggagatcagggacaggctgtgccttgagatggaggggaaaaaggtcagtaggacagagggtaacatcaaagacttgcccattagtgagaatgcctccactgaagacccctagggtaaaggtacagaaagcacagtatttgatgctgttgttatcatcatgaaacatcactcgccagaaaccagctccgcaaaagaagcctacaggaaatacatcaaaaattacgtgagaagagtcaaaggcaaacgtgaagaacagagaccgtaaaaagtaaaatcttttatgacagactgcagaacaaatcaagcacatccttgctaatttcaaaaactaccagttcattatttgtgaggacatgaatccagatggcatgctggctctattggactaccaggaagatgacgtgaccccatatatgattttctttaaggatgatttagaaatggaaaaatgttaacagatttggcaattgctttgatctatcacctgtcattataactggctgccacttgtcatccacacaacaccattgaagacaaatgggactgatgtcactttgagcactttattttgaccatgatttatctggagtagaggcattgtttttgaggaaaaaaaaaaccatagcatatataggttgtctaaaaataaaatacatttaaagttaaaaaaatacaactctgtgacctagactggagctgtcaactacccctccccaacccacatatatactcacatggagctccgcgaaagagagaagcaaaatttctttagaattttttagaggtttatttatttatttatttatttacctttcactggaattttttttttttttttttttgatggagtcttgctctgttgccaggctggagtgcagtggcacgatctgggctcattgcaacctctgcctcctgggttcaagtgattctcctgcctcagcctcccaagtagctgggactacaggcacatgcctccatgcccagctaatttttgtatttttggtagagacagggtttcaccatattggccaggatggtctcgatctcttgacttcatgatctgtgccccatatttaaccagtcacggatagggaagacccagtgatcgggtgcaagtggttttacaatccatttctttttcatttttgtggtgtagccagttgtttgggattacaacagtattaaaatccttaaaaataaagctcttctcatgcctgtaatcccagcactttgggaggctgaggcgggcagatcacttgaggccaggagtttgagaccagcctggccaacatgcaaaaccctatctctactaaaaataaaaaaattaaccaggcgtgatggtgcatgcctataatcccagctacttgggaggctgaggcacgagaatcacttgactccaggaactgaaggttgtggtgacctgagaccacgccactgcgctacagcctgggtgacagagcgagactgtctcaaaagaaaaaaaaaaggctctaaaagatgtccatgatggacatcactgtttggcaatcaggaccccttgtttttctaaaggtaccttgatgtacttcttattgttttaatgtaatggcagatcaagttgctctgcccttccctacccaagacttgcgaactggttcccaattaggcaactcggcttctac

SEQ ID NO: 8104 - DNA, 848 bp, mus musculus
ttgagtcagtgctaattacgatgtccaagaaggcacaatgatcagattatcaaataattttttagcttgggaagtgatgaggagggagcttcaagtggggaggggtctctatttgcatctatcaggctacactaatgtgaaaagtctgatgacagacctgcagccctttcacttggtacagtgttcaggtgctcacacaagccagtccagactttggaaagctgatggttcatgaaagaaagtggggtttgcgatggaggaaggtgttctgtgtgttacgttgagcagggtggtactatttttccaggcttcagtggagaacctaagtgttatctcagaggggtggagggtggcgtgtggcctgtggccatgcctggcatggctttccaggatggtgaggaatattttaatctcttttgcccataaggcaggggttttcaggaccctaaaacaaacttcaaagagctctaaggacttctcaaagtcctttttggatagtaatgcaatgtctgtgacgtccaaaggaagaaaattcgtcagcggagatttgaactaaaattacttgtgctcatcagcagtttttgaagatgcagagcgctcggttatgaaaatagaacaaaaatgcacatctagtttgtccttagcacttctggttcatcatactttgaaaaagcctggcctgttgcccaagtcttttgaggcaaccctgggttgttgcccaagtcctttgagggtaagcaacagcaatgtctcagaaaacattaactcaacagcccacccgctccaattcattaagccctcatcttttttatctgaccaatagatgcccccagttaagatctaaatga

SEQ ID NO: 8105 - DNA, 1198 bp, mus musculus
aaatatttgtgtcccaacagcttttgtagctgttcaaaaaaaaaaatgcagaaaaaatagaacatttattttcttcataagtaaccacaatttactaatgagatgtgtgtgcttgttgagcactgagcactaaatagcttttctttttctttctttttttttttttttaagatggagttttactcttgtcacccaggttggagtgcaatggcacggtctcggctcactgcaacctctgcctacgggttcaagcaattctcctgcctcagcctctcaagtagctgggattgcaggcacccgctaccacacctggctaatgtttgtatttttagtagagacggggtttcaccatgttggccaggctggtctcgaactcctgacctcaggtgatctgcccaccatggccttccaaagtgctgggattacgggcgtgagccactgctcccagcctgcatagcttttcaaaccttggaacagagtacactgccgtcctcatttcctgttccacattgattttcaagtgacacttgcttttatcacagcaaccagcaaaaacccggtttcactaatatatatcatccaaggaatgcactgcaatctaatatgacaactcaagcacctcaggttaatagtttggctggtttccagcatgtgttgagaatctcagtgtttccttctgtttaaaatatgcagcttccctgggagtttgctgtagtgccgtggggcatctgagcacacagttcaggagatgtggcatttgacacactttatttcattcagttcagattgtgcttttatccacatttcagagatttggaaactgaggattggaaagataactgccccaatgacatagtcctaccatttaatttttttttactgtaattattgtttgtgctgttgtgaggctattgtattaccatatattgtgtggctattattttcaggggtggggaatgaagtgtaaaaataagggaaggcgttaaggttaagagtgtaattggtagcattttctaatgagggaactgtacacttgtgtttttccctacaaactattaacatattaatatattagaggagaaagtatggtttaatttacagtaaagtcattaaaaacaaagtttctttcctgggccaagttaaatgtcaggttctagacttttggataaatatagtaggtggtaatgccaaacagtgt

SEQ ID NO: 8106 - DNA, 1198 bp, mus musculus; identical to SEQ ID NO: 8105

SEQ ID NO: 8107 - DNA, 893 bp, mus musculus
cacaagcttttcagtgagaaaattgtcctttttttcctctttctctgttcttacctccccccttccttctctccttcccttttccactctttcctcaaacatatattgaacacatagcaggtgctaggtcttatgctaagtttggaaaatacacctcctgcatgaatggaatgtatattgtgtgtgtgtgtgtatgtgtgtgtgtgtgtgtgtgtatttatgtgtgtacatgcacacaagagcatacaccctgagaaagcaaggaggctcacagagctatgtgtgctgccttttcttagcaactttaactctaaagagtcctggaaaacccagactattgactagattggagaacgatgataagctccttcttcaactactcttgccgggcaccctcatgactgccgttggcttctcggcccacgagtctaatcacttgtgttcattcctggcttgtgagtcacagaggagtcatccctgaccctgacccataagaagaatggtcatttatttaccctttgaaacgtgaccaggtggctcattaattttgcagcattaattctaaggggaaatgagattccaaccagcgtcattaatcttgtaaaaatacagccacgagaagagagcatcgataatcagaatgtaattttctgagttaggaagtggtcaggacattggtgtcagggatccggcacatctaaggttttcatggcattctcgccaatggcccaaccaggtcaaggcaatggttttaagcctggaagaaaaagaccacttcaaaggttgttgattcctaagatagagcttagacccttctctggcaataataagaatgacatctattgaatcattaatatctggttgttaatcattctaactaaatacttttttta

SEQ ID NO: 8108 - DNA, 1067 bp, mus musculus
ttctctattgctatacacaaaccatatatatgacagttttgcatatttgcaaatgcaaatatatacacaaccaaatgggagaatgatctgcatattgtcattgtgctgacaaacctgtcttgatcactgctacggtgactccaaatcactgagtgcttcgaaaaggacaagaggaattccatacggaataggcaattaggttttggaacaatgtgcacaggctggtgttaactggttcccgtgagtcagggccattccattttggggattaaacacatcagcagaatgcccctttctctgcagctgacaagggggagttccaccccatacactgagggagagggtccccagaatcttccggggagtgaggaaacaaattccaacccccaaacaacctgattggaaagggagtgtttttatatacacatgtctccgaaatccggccagcaaatgataaacatcagctggtgtttagctaaatgttaaaaatcttattgaggcaaaagcaatgctagaaaggaacaacaacgaaaaaagccagctcagcctctgccccacggcctcgatttctctcccaaatcccaggtagctgagaggtggaaagtctagaaacagaatcgaacacgtctaatctcttttacaacaatgttcttattttaacccatgtcatcaggggaaatggctgaaaatagtgacaaatacaacatcaataaacataataataattgatttcccagagatgaaaaatttgaaattattggccatttccccctagagcattggttgattaatttaatgttcatcttagtctttcaaagacatcctcttatgttgatctgctttgccagactttgtgatgggttttgcggtttagggcccagtggttaaagtatattgcacagttctgcagttttaaagagaattctgatagtttaaggatgactgcagccaacaacagcaacaacaaaagttaagacacatcaagcaattaaatttccagagattggaactggagtttttcatacaggatataagttcagtggctgtactactcagtttttctagct

SEQ ID NO: 8109 - DNA, 843 bp, mus musculus
aaaggaagaggaagagacagacttcctcccacctcccaccatgtgaggacacagtgaggagatggctgtctgcaagccaggaagagagctgaaactgctggcaccttgattgcggactcccaacctacagaactgggagaagtaaatttctgttgtttaagccgcccactctgtggtattttgttatggcagcctgggccaactaatacagaaggaactaagttaaacttgtatttttcagaaaaaaagcaactgtttgaacaggaataccaacattcaagcttgtatttgagtcacatacaggcattcccatttacctatcttttaaaaatagtcttttccttttaaatttctttccaactttattgggcatacaataaactgcaagcatttagaagtgtataatttaaagagttttgacataacgtttatccctgtgaaaccatcaccacaatcaagacaatgagcatggatctgtcacccccagaagtttcctcctgtccttttgtcgtctccctccctcccttgtccccagacaaccactgatctgttttctgtcaccatagatttgtttgcattttctgaaagtttatataaatggaatcccacagtatgtgccgtctctctccttttctggtctggcttctttcactcagcaaagctacttcgagagtcattcaggctgttgtgtacatcaaagtttccttcttttttactgctgagtaagagtccatggatatatacaatttctttatccatttcccattagtggacatttgggttgcttccagtaggtatatgtttaattttttaagaagctgccaaactgtttgccaaagtggt

SEQ ID NO: 8110 - DNA, 958 bp, mus musculus
cagactgcactcaaaacagcagaaattctctccaagaaaatgtgtaaatagctagtttctacaggagaggaaacctctctgagtttgtcaccttcagctttggttcacactccacctgacccatttaattatacaagggcatcagtcattgaaagctaaaattaacagttcatgacttttgccagagagctctgatatctccagtggaaattttccatactgctcttgtgacagactgacatccactgatgttgccacagagaaacaaaaaataagaaatgaggtttttgccttggtttttcagtaattgccacatggacagcctgcctggtcttggtgacaaccccactttggtcacattcacataacacatagtttttagtcattgactgtgggcctggtgctgagagtaaagaagtgcacaagacaaagagcctgtgcccagagccaggagagctggcctcctacaccagccccagcactcactggccacatgggttcaggccaagtcttgaaaatcacatagattcgaggcattggaagagttcccagggaaagaggcactccacaccaagtcaggaagagccagattaaattcccagctccctcccttaccatctgtgtggcatgagcctgaggtcacttagaaatggtcagaaaggaagaagcagatgaaatgggagagtgcaaggaagatccaggggaaaccacatagctatcgtttcttctttaatcagggtgtaacattcatatagtaaaatgtaataacatgcaccaatcttaagcacacaacataaggaactcttcacatgaatcccatataaccaccacccagatcaagatatagaacatttccagcacccacagtagacagacattttaatgtgaaaataccaaaagttgaatcccacaacttctattatgttaccacaatcagtcctgcctcactccagtgcca

SEQ ID NO: 8111 - DNA, 909 bp, mus musculus
agatgttcatcaatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaataacagcttatgatttatgtaaaacaagtgctatctataagtccgttacttaaatttctgggagaaggcaaagcagcttcaccctctgggtgaaccctggaaagggggagggtgggaaccacgatggagaggagtggcaacttcttctgtgatttttattgaagagaatatggtcttgcgtaagttctgtttcctctagtgattgaatactactttctaaattgaaaattatatcacaggcactttgctgagtaattagaaattcttccaaaccatgatttctaatgaatgcacggtaaatagatttgctatcagttatggagtttttcttctttcttctaaataaccctaaataaccttctaactttcttctaaatagccctaaatagatggttcatgtgcaaagttttgcctatacagtactttgtgctctttcctcgggagaaatttctggaagtagaattattaatgcaaagagtgtgggcattttaagactctcaatacctattggcaaattgcttcacataaaagttgaaaggtctgtccttaagtcctgctgcatcttttacacattgagcagaacttttatcctttttattgaaaaaatctttgtgaacttgacagatgagaaaaatgccgtctcggagctattttatttccatttttattgttagtgacaatgaactcctatgttgggtcatccgtcgtttttcctttaatttaaaataactgtctg

SEQ ID NO: 8112 - DNA, 1575 bp, mus musculus
tcagagcctcagaaaagttaagaaatcttccctgggtcaagctggtaggaggagggactggaactgaactcacatctccacctcctctcttcctactcctctgcctttcttgcacctagagcagtgtacaacatcaacaactgaccagggcgatcctagaggtaagagacagccgaatggcacggacccagccaagcccaggcctgcccaggtggaacagagccagctaggagcattcggtagcagaggtcagtccgctgattgactgttctcacttccaggcccacagcctcctccaccctgatggtctatgagtctagtgcggccctttgcacaattttagcaactgaacccttttcctcacagaattgtgataccgtcctaacatatgaagcatatataaacagttgggcaaatcataatagtttccattatttcataaatttgcatttgtggcaccaaggagagaattaatgggaacaagagggttcttgtgtgagttccgcatttggatttgggggttcgaggtggcagctataggctcacattagtgtctgcatcactttgcttcagtttgtcacggtggccccccaaatccagaaccgccctcctcgctgtgtgaggagggtcctgcctgcaccgctttgcagacatgggccagcctggatgcctgggcgacgctgccctgcgactcgctggcctgcaggacatctgcaaaacattcaggtctcacggcagtggccatgaacggcctcacagacactgagtggacctgaccccaaagagaatgcgtcgtccttgaacgtgtcgatatttaggttattacacaatgagtgtgttgctttgcaattagtgtctgaaagagttagagcagatgtacatatagaaacgaagaaacgaaatctgaatccatgctgacagattccccctccccaaaccttgctcaaggtaacacaggcgaccaggagcaagtcccggccggccccctgctagcgtggtctgagtggcccaagcaggacccctgcccaggctcactggactctcctggagcccccagacacgacacccttcctcatcactgaaaatccacttccacagtgtaggagatgcatggatctgagggccagtaggaagtgctggagctttaggctttagacattctttttttttttttttttgagacagggtctccatttgtggcccaggctggggtacagtggcgtgagaaattctttaacactctgccgagtcctggcccttggggagtgaggcctggctatgaggcttcttgtcagaactccgtgtgactctcaggatggaagaacagggtgggggctgctcctcccctccctccctccagcccctggcctttgtaaaacggctccgcctacgcgcctgtagccagtgcagaaccagggaggcctctccccttcccttcccaggaggggccccgccttgtcctccatgccggattctgttcgtcctcccccaggtcctctctgctgcctcccactgccccatttcctccaggaaccttcctctctcctaccaccagcctctctcctacccccagac

SEQ ID NO: 8113 - DNA, 798 bp, mus musculus
ttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaa

SEQ ID NO: 8114 - DNA, 798 bp, mus musculus; identical to SEQ ID NO: 8113

SEQ ID NO: 8115 - DNA, 485 bp, mus musculus
atgacatttcagaatcaaacattccccaaagtgttgcagagtgtctgttacatgaaaatggcccagtagaaacttaacaaacggctgtgatccaacagcagtggtcatagacacgtagtgggtgcactgggaagagagtgatgtgtgggacatgctgatcccaactctggggcatgagcatggggtgggaaggccaaccctgggccccctcacccatactcacttccccccatcctctgccaataggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtaagtgcgttgccagccctggctcaccctgccccaggaactgagactctggggtcctaagtcctgctctgccctgtacacgctggtgatcttgca

SEQ ID NO: 8116 - DNA, 557 bp, mus musculus
tccaatccatgaatagcattcatgccccaaatggccaatcttatattcgtggcagacatcacaaatcaatcccagcatgcttctccgtggagcattgattcggcttctaaattctcaagtcaacgttccaagtagtcaccttctattgagatcagcacataagaagaaatgcaaactagttcaacccttctattttgtagatgaggaaatggaggcaaaataaggtgtcatggggggtctgggtggaccagctggtgccctctggctgcctgtttcatccagcctgtccagaagctccagagaagccctcgtccagctgggcaggcagggggtgccagagagaagcacagctgggcagctggcatgggctcatcccagcgcctccctgcccagccacactgcgatcggctctggcggtgtcccttctgtcccccacccgcctgctccccacagctgctcttttgaaagccctgcatgggaagctgttgatgcgtctctctgttcccttttcagaccattgtcccctcgctggcgccagccgtgttcttctcttggct

SEQ ID NO: 8117 - DNA, 820 bp, mus musculus
ttgccacaagtatattttactttcagaattaaaagaaagtagatgaagttactacactattttttctagcctatggcattttcactaaggacaacacacattgctactaaatattggtacagctaaaaatttcattaagtacttttaataacaactttcatttgtatagtctgccttttacaaagaactttcatgtatgctcttgcctgggtctcaaaacagttctttatagttgggatgactttcttttcgtttttgagacagagccttgctctgtcgcccaggctgaagtacagtggtgccttctcggctcactgcaacttccagctccgcctcctgcattcaagtgattctcctgccttagcctccagagtaactgggatcacaggcatgcaccaccacacccggctaatttttgtatttttagtagagacaaggtttcaccatgttggccaggctggtcttgaactcctgacctcaagtgatctgcctgccttggcctcccaaagtgctgggattacaggcatgagtcactgcacctggctgggatgactctttattggatatatctgtatatgtgagtctgcatgtgtctaattcttaggtaaaacacattcacagaattcaaaaaagaaaaatgtccattgagtttactgagcacctagcaggtgccaggttctatgtgataggtgctatatacactgacattatttcattaatcctattattatctctattttacccatgaagaagaaaggtttgcttcccctgagtgccataggtgatgtccagaaggaatgtatcctagactccaggcctt

SEQ ID NO: 8118 - DNA, 1255 bp, mus musculus
catcctgctttactggctgagttttctgctccttgaagccaggggctgtgattctccacttttgttgtagccctcacaggcctgggtccatggtggatgctccataggtatttgggtaattgttgtgggtagatgaaaggatggatggatgtttggtgattggctagttggttgatcagttggttgcttgattggttgttcagctgactggccagttggttgcttggctagttgactaactggtggttcgttggagaattggctggctgcttggttggctagttcttagcttggttgactgattgagtggctggttggcattttggttggtaggttgttttgatggctagttagttggttgcctggttagcaggttggttagttggttgcctggtttgttgtttggctgaatcttagatgattatttggatggtggctggctggttatttggatggttggctggctggttatttgactgactggctggctagttatttggatggttggctggctggttatttgactgactggctggctggttatttggatggttggatgactggttatttggatggttggctggctggttatttggatggttggctggctagagaacacagttagttgagtggttatctggctgttccattggctgattgctttgctgtttggctgatttgttagatggttgactatttggtaggttggctggttagaagttaaattgtttgactatttgttgtcagttggttggtttgttgcatagttggttggctgtttggtaggttggctggtttattggttgactgaataggtggctgattagaagtttgaatgactggctggtttgttggctgaatggttggttgatggttgcattgcatgattgatgcatgattggttagttggctgtttgttggctggttgactggttggttggatggtttgttgggtgcaggacagacactggaattgaccagggttagtcatgactcctctgtatcattggctataaccattatggagggggttgcccaatgtaattcttttcttcccattatccttacttctatctctccagctaccaaactgttccctgtgggctacaacctcatgaagccattcctgagtgaggacactcgcaggaaaattattgtgttgggaagtaagtagtgccagctcaatttcctgacctctatacatgacctttggagtgaggttgtcccattaccccatctagaactccacacatta

SEQ ID NO: 8119 - DNA, 1014 bp, mus musculus
acgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtaga

SEQ ID NO: 8120 - DNA, 1959 bp, mus musculus
gtaagacaaagctgcaggagcctttctgggcgtttggtggagcctagcgagtagccagccccagaatccagtgtctcccagggaagacggctcagcggaaaaacccggttcatgctgacccgtggcttatcagtgctgggggacctacagagtgagtcctctaggcggcactccctgcctatgcaggagacccctggcaccatccaggactcctagcaatgggaggacattcagctgggcagaggctgggttagatcaggacccaccccaggctgtctaggctgggtcaggacgccactctctgtgcacttgctctcccccagctcctgcacaggcagagcacccaactgctggcacagagactcagccggacctgcttccgccagtggagacaacaggtgggaacccaggagatgtcccctctgcacttccttctccatcctctggcctgtgaggcctgggcagtgaatgaccttcagcctacacctctagttcagtatttttactatcaccctccccagggccacctcctctaccaccttcctgtcatttccaggcacatcagcttccttccgtctgcagtctgcataagaacagttacttcaaggccagtttctctctctacagtgttgtattaaaaaatacatcagtggaggccgggcgcagtggctcacgcctgtaatcccagcactttgggaggccgaggcaggcggatcatgaggtcaggagatcgagaccatcctggctaacacggtgaaaccccgtctctactaaaaatacaaaaaaaatcagccaggcgtggtggtgggcgcctgtagtcccagctactcgggaggctgaggcaggagaatggcgtgaacctgggaggcagagcttgcagtgagctgagatagcaccactgcactccagcccgggcaacagagcgagactctgtctaaaaaaaaaaaaaaaaaaaaatatatatatatatatatatatatatataatcagtgggccgggcatgatggctcacgcctataatcccaggattttgggaggccgaggcaggaggatcacttgagcccagaagttcaagaccagcctgggcaacatagtgagaccccatctctacaaaaacaaaacagaaaaattagctgggtgtaggcagtgcacacctgtggtcccaactactcgggaggctgaggcgggaggattgcttgagcccgggaggtcaaggttgcagtgagctgtgatcatgccactgcacttcagcctggatgagagtgagattccatctcaaaaagaaaaatcagcataatatcttaaaaattaacatgaaatgtgttttaaggctttgctgggatcttgctttttaaaaagccaagagggatcacacagagcagcatccacacgtccccagctccctcttcccgttctgttgtcctgttttcaccattccccggacctcaggccgctgcctccacgcatccccctgcaggagccctttgccaccttctttcatgaaggtcattcctcaggccacagatggagcgtgtgttgagcatctcaccgccaggcacaaggctggcccttcctagtggaggaagtgggagcctcgactagagagggagccaagagggacgagctgggcagggccccgtgatcaccacggcctccttgaaggggctatagggaaatgatctggtctttctggccctagctggcagccaggaggcaggagcagcgggcgacagtgcgggccctgtggttctgggccttctcgctgcaggcaaaggtaattggggctctgcatcctaccatccctgcctctccctcaggccttagccctgccttgggtggagggagggcacctggtctgtgggggagctctaagcagggagacctgggcctcacctcctgccctccctggaggtgtgggccacgtggctggcctttgtactggaaaggaggagaaagaag

SEQ ID NO: 8121 - DNA, 1410 bp, mus musculus
ttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccaggggaacagaccccatgtttctttccagcaacactgcccactcagcgaggaagcagccgcgacgcccacacttcctgttggagcctgcgcagagccagaggtccctggggtgcagcaccgtgggcaggcagggggagatggtcaggggtccccaaaggcagcgggcacctccatgtggggcctgtgttttggcagccctggggtgggtggccccctttccttcttgttctttggtcccagaggagggtcctgtggcctgaccaggctcttgccttccctgtgctcaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtacgtcctccaccaccaggcctgggcactggggctctcactctggtctgacttctggtgctttctcatgccacagctgtactagtttctggaaaaccttggcacagggaggccactcatccatttgacaagcataggtagccactgcacaccaggtccaagggccacagcagtgaacagccagccaagggccctgccatcctgaagcttatattctagtcagagacaagcaaagaaaaacccctgcctgcaggccagtaaagtggctgcagatcacgtagggtcctgcaggccacagtgagaagtagcctgggatttgagaagagtaggaagtcggggaagggttttggcagggagcaccatgtcaggtttctgtgcaggctgtggtcaccatgaccacgtggtccaggcaagtagtactggtggcctgggctcagcggttgccacagaggggacaggtactctcttggaggcagatgaggcaggatatgctgctctgagggagttgctgaatgaggggaaagaaggaatccaggctgatgtgggctgctggcttgaataacttgggaaacagagttctttgactggaagaaggaactgggggtggggactggtttggggtgaagtgtcaagagtgttttgaaccaggctcttgatgtcaaatttgagagaaagcaaacgttg

SEQ ID NO: 8122 - DNA, 1415 bp, mus musculus
accgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggtcagcccggggccagcgtggggggagctgcctctgtgggcttcatatagaggctctcagcttcttggtgttgggggaccaggctccagatcagggtcattgaggccaggagttgactgctttatgcaggctggttgtgggcaggggaccgtggggcccagtcagctcagcatttggagtgacatcggggcaacaggccatgagtccctttgggtcttggctgccatggggtggacacaccgggctctggacggggagtagcggcattccctgcctctgcaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggtaagcaggatctaggccctgccaaagcccaagggccagacctcttgggtctacctgccttgtctgctgtgcggcggatgcgttgggactgaattctagggaggccacagctctggtcaggcctggctctgctgagcagctgtcctgagaatggccgctccacctgccagccagctgaggcttccctccctccttgcactgctggctggaagtggctggaagagatggagggaattaacctccttgcctggcacctggcttctgctaggaaccatggtcaaaggtgagagtgaggagggaacagaaagggagtgttgagctcggggtggctcatgttggttacagcatgaggggtcagcactcgcaggtctgctgcccaccctgcccccaggggctgcctttttgggtgtcagtttgtgaccaacggccttggctcccacgggtgctgctctcccagcaccatgcatggagaccactgggccccactgttccctgtcctccctgggcccagttcacagcaggtgtcaaggctgtgtgtgagatctggctagagcaggcccacctggccctgagatgccatccccacctcccttttggagctgggttgggtggtggtggggacaagcaacagagggagtgggactccaaacacatgtgggggtgacactgtgcacttggtggcct

SEQ ID NO: 8123 - DNA, 4772 bp, mus musculus
gtcagagttcacatccagcggcctcgcagtagaggtggcggcaaggggactggtggtcagcccccgaggctggaggagcctggcctggggggcctgagcaccctgagtcggagagcccgcttcaggtatctttggttccaaccatgaggagggcccagcagggggaggctgccagcgagcctcagacctcatgcctgcgatcttccctaccctggtgctcccaggccccctgctcgcagcccagacccttgcctctgcaccccacctaggagagaggcttccccattccccttcctgcccatgggaggggtgtagctcttcccagttggtccctgctcttctgcagtgagtggggcaggtggcaaagccagaggggagcagtgatttgtctttgcttggcccctgccaccttcctggaccttttaaaaatacaccggggtgcgatgggagagaaagtaggcacccgggagctgcgtggatgcagccagctctgagcctgagcctgagcggggttcgccactggttcgcctgccgtctgctctgctgctatcagctgagatgctgctttgttccttggtttgctcagcaactgggagagaggactcagcttctcttgagagcacagtcccagatggcagccgtagattagctaaatgcagttactttgcagatgaggaaactgagacctggggacgttctgagtggatggcagtgtggtctcctgctggctaccctgggcctcaggagcatttgctaggcctaggcacagacagggtggggtgggccttgtttaggcgcaggaggccagggttgtggtggaaaggcccgtccagcctctgcggctctggtgaagctgagcccctgctgagtgccctgcatttgtgctgggagggtggggagaggccggatcacagagaggctggatgcagaaaggaggggcttgggtctcgtgtgtgtgtgtgtgtgtgtgtgtgtgtgtgtgtgtgtgtgtgtccacctttgctgaaaggaggggcttgggatgggtgtgtgtgtgtgtgtgtgtgtgtgtctgtctgtgcagccccagcagagcagacaggtggcttgagagcttgtggtggggaggttttgttcacaaacctgtggatgggttttcagaacctggcctgttatagaaagaccatgcagatggatggagccgtagctgtgtggtggtggtaggcggagtgtaaatgctccctttgagatcttgtctggccttggccccgtaatttagcagatgaggaaagggggggcctggaaccatgaaaaggatatcccagatcctgcaaaggatggtagcggaagactcagcaaatggttacccagctggctgggtcgtagctcctcagcgctatgtgctgccgtgccagtgcctgtgtggcagagctggcccctggggcccactctcctgggctgcggaggctgagggatgtgaggcaggccctacaccctgctctccccttcctgggcccaggtgcttgggcctggaggcccttgctgggagctgctgcagctgagaggtgccccgcagctgggcctgactctcctcttgcggctgcccccacattcccagtcctccccagctggctggcgggtgggagagcctgggaaatgagtccgctagccagaggcagccaagcccctgaatcagaatggggttgggacgagggggcacagccagtgcttgctgggctccatcacccccatggagaggcagcttgccaagggtgggtagacaggaggaatcctgccctgggtgcaggtggcagcctcctgggtcctgcccagagcctggccactgacctggctgtgcatggacctgtgccctgcaggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtaagtgtgcacaggcccctgtggctcggacctcccttccgggcaggcctgaggttggggtgcaggagagactgaggtggtggcgagctgtcagaagcagaggtcaccgctacatcttcagggggtccgggtcggaaggttcattggtgggcaaggccaaggcagcttttgagaaggccactacctgggccgcgggtgactgcgagggcatgtcgtgccctgcccactcccctagcctgcctcatgtctgccatttggggctctggttctggaaggaacccagtctggggattcagaaaatggtgtctgtctctgatttttctgtgttcaagcaaaaaagagcttataggtgattttgaacagaagccaaattaattccgggatgccaaaggggtggttcaggatggatggatcctgtttgggtcccttagggtgaggacacccttaaggaacccagaggcatgccccaggaatgggcaagggaactggcttgtcctctcctggtccctagagggcttgctcttgcccttggcttcccaggcaggttgaccccaaggaggaaaccctgttcctgggcctttgacagtcacatgggtgtcatcagagctcaggggcactgaggcaccctggacattagcccaggctcccacctgtgcctgggaagggcctgggctcacatagcccttctgtgtgactgggcatcagctggaagggataagagcagctctctgggagcttaccttaccttggagaggtgttgaaagttggaatgaaatcagttttacaccttggggagttggtgtcttggttgtgtttagagaagcagcagccaccaattacaggcagcttctacagtggcagcagcacctgaagtttaagaggctgccccttcctgggtacctggccctgccggagagctctgggaccatctagtgggacccagtgcttgtccccaggccatcgtctgtcttaggtgctccaggcttccctgaaggaagagagaacagaggggcctgaggggatgacttctctttgcctcctgggaggaaccccaggtgcagatggctttatggcctggctcagtcacagtagaacgttgaacacaagtcctgccgtggggccaaggtggggctcagcagggctgggcttctcagactggctgcatccaggccctcaagagtgctggctggacctgtgggggctgcagaccctgtgtctgcagctcaggcccaggtgacagtgacatcgcagacctgcatctgaaaatccctgttggtgctcagggtatcctccttcttcctgttaagacagagggacacactttgggctgtagacttgttccatgcacttgggagcctcctcctttggtggtctgggatatgggcagtgaccacgggcaagatgcccaccacctctccacacactgtgatattggggtcaccgtggctagggtcacacactgtggttaggatcagatccgtttccgacccccactttaagaagtaagactgctgggcgtctcccgttctgggactggagcagttgctatttgacttttgcatgaaatgatgaaatccactggagttgtatgtaaatccagcactccgtgtggcaggtgcagtctggttcccagtgagaaacagccacatcacaaaagcagcgtggggcacctgggccctggtgtcctccgtggggtgcagattctcccctgaagtgagagctgggctaatgacactacttgggctctctggagctggggcagtgtggtcaactcagccccttgccctgtggcctgcaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggctaggcagccctgctgctgtgtggctggaccgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggtcagcccggggccagcgtggggggagctgcctctgtgggcttcatatagaggctctcagct

SEQ ID NO: 8124 - DNA, 1148 bp, mus musculus
ggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggtgagatgctgcccaccgcgccctaaccccacggttccccgccacgacctccggaaggtcagagttcacatccagcggcctcgcagtagaggtggcggcaaggggactggtggtcagcccccgaggctggaggagcctggcctggggggcctgagcaccctgagtcggagagcccgcttcaggtatctttggttccaaccatgaggagggcccagcagggggaggctgccagcgagcctcagacctcatgcctgcgatcttccctaccctggtgctcccaggccccctgctcgcagcccagacccttgcctctgcaccccacctaggagagaggcttccccattccccttcctgcccatgggaggggtgtagctcttcccagttggtccctgctcttctgcagtgagtggggcaggtggcaaagccagaggggagcagtgatttgtctttgcttggcccctgccaccttcctggaccttttaaaaatacaccggggtgcgatgggagagaaagtaggcacccgggagctgcgtggatgcagccagctctgagcctgagcctgagcggggttcgccactggttcgcctgccgtctgctctgctgctatcagctgagatgctgctttgttccttggtttgctcagcaactgggagagaggactcagcttctcttgagagcacagtcccagatggcagccgtagattagctaaatgcagttactttgcagatgaggaaactgagacctggggacgttctgagtggatggcagtgtggtctcct

SEQ ID NO: 8125 - DNA, 1022 bp, mus musculus
ggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggtgagatgctgcccaccgcgccctaaccccacggttccccgccacgacctccggaaggtcagagttcacatccagcggcctcgcagtagaggtggcggcaaggggactggtggtcagcccccgaggctggaggagcctggcctggggggcctgagcaccctgagtcggagagcccgcttcaggtatctttggttccaaccatgaggagggcccagcagggggaggctgccagcgagcctcagacctcatgcctgcgatcttccctaccctggtgctcccaggccccctgctcgcagcccagacccttgcctctgcaccccacctaggagagaggcttccccattccccttcctgcccatgggaggggtgtagctcttcccagttggtccctgctcttctgcagtgagtggggcaggtggcaaagccagaggggagcagtgatttgtctttgcttggcccctgccaccttcctggaccttttaaaaatacaccggggtgcgatgggagagaaagtaggcacccgggagctgcgtggatgcagccagctctgagcctgagcctgagcggggttcgccactggttcgcctgccgtctgctctgctgctatcagctgagatgctgctttgttccttggtttgctcagcaactgggaga

SEQ ID NO: 8126 - DNA, 17522 bp, mus musculus
ctcaacaatgtgttcctgcgccatgaacggtagccccagcacctcccctggcctctggcctactgccccaaccctctcccttcccttcctccctgttctcctggtctcatgccatctgagccttctctcgtcctcctctcaaacacaaggcaggctcctaagggcctgtgccctcagctgtcttcttccaggatgtttatgagggcccctccttccagccgccctgtatctcctttccagggttagcgctgctgcctgtgcccaagtccagccctgggagatggtcacaggtcacagctgagagcacggccctgcaaccagactggcctggtgtgtcctcgcccactccaccacttcctggttctggggccttagacaagtgacttcactgctgcaagctacacaaaacatttctggctaacttaggcagaaaaagaatttgttaggataataatctttattaaatgggtagctttcagaatccagagaaaagtgaaactgatgtctcccaacagaacaagaaagatggatcccagggcagctcagatgtctcaggagcagaaattcctggaccatctccccagggtgctgccatcaataaatacatcagctcaaacacttgtccacaaacacctgtccaccttttttttttttttttttttgaggcacgatcttgctctgtcacccaggctggagtatagtggcatgatcacagctcactgcagcctcaacctcctgggctcaagcagtcctcccacctcagcctgccaggtagccgggactacaggcatgcaccaccacacccagctaattttcttttctttttttttttttctttttgcagagacaggggtctcactgtgttgcccaggctagtctcaaactcttggcctcaagcagtcctccctccttggcctccgaaagcattggtattacaggcatgagccaccacacccacctgcccaccttgtatcattctgttcaagagtcacatccccaagagagacttggattggctgagcttcattgtgcctaccagctggggtatgggagagggccctttgatggcagccccaccgggatgatgtgaaatgggggaggagcagttcctctaaagagtacttaggtgctattacaaaagaaggagaagggctgggcgcagtggctcacacctgtaatcctagcactttgggaggctgagccgggaggatcacttgaggccaggagtttgcaaccagccaggccaacatggtgaaaccccgtctctactaaaaaatacaaaaaaattagccggaggtggtggtgggtgcctgtaatcccagcttacttgggaggctgaggcaggagaattgcttgaacccaggaggcagaggttgcaatgagccgagatcgcaccactgcactccagcctaggcgacagagcaagactccatctcaaaaaaaaaaaggaaagagaaggagaaggattgctgggtctgcagaaattgtgtgcccatcacacctcctctgtatctgtaaaatgaggcttgtggcataagtgagagtccatgaaacagtgtctgtaaagcgcttagcagtccagggtgtctgataactgacatgagttattccagcctcctccagccccttgttcattttttgtgtctttctccatcaaaagacactcactgattgattctaaatcagtggaaagtggggggtaccctgcaggtcacgtctgcctagcttctcctgctcgttggcccagtggaatgaaaggcctcttccctgccattttggggtatgggctgtgaggtgactgaggggccccatctggtagcagctggtaccctcagatatccacagtcattaggcttaatatctgactgtgctttcaagctcgcagtcacttatacccatgtcctaatttgggcttcagcacttcagggaggcaggtgcctacagatactagacaagcagactaaagttcagaaggaacataatttacccgaggtcatgtgataagtgacaaggccacgacttgaacagaccccacactaaagtcttctcgatctatcacaccggcccctaagtagctccataaaacaagattagagatacatgtatctttcttacagcactgaagagagcactaacacacacacacacacacacatacacacacacaaatatgtaattgaaacaagtttcataagacagtccttacctttactgcgtgccatgcattcctattttctttgctgttctaacctattcctgtttatttgtttcatgctactcatgactaaggttgccttataattgatcatccaaattgggacacttttgcaagggaaagaggagcactgctagttacccagggacagcaggcatgaactggatctgtccagggcacaccagacgtgtcatcaccctgatcataacccaccgtgttgatgttgagacccacagtttgaaaagctctgcctggccgtgtgtgggggcctgtctcagtctgtctccataactcgtgtcttttctgtcttgtaggtttgaacggttccgaacaggccagaccaccaaggtaaaagtcttcttttctgtgactagatcaggccctgttcatgggaagaaggagtgccattctcacctccctcccctagtaaactggacagggtggtgctgtcttatccaggcccatagagaaatccccttctaactttttatgtccctgtccctttaaggtaaataaggctgtgccaccacctgatgccccagggtctccccaacctcccagggagtccagttgagctggagccagaggggaggaaggaaattccctgatgcccagtcctagctcctggggccctggtgacagatccctgggcaaagcctgcaagccacagtgcttggggcagaaaggaacgaagctgcagacagcggggatgatcagggcatctcccttcccaccaggccccaagtgaggccgagccggcagctgacctgatcgacatgggccctgacccagcagccaccggcaacctctcatcccagctggcaggaatgagtaagtgtggtttggagggctccagctgagggtacattatggtactgtgggcacccctgcagattttcggggtgcccttgttatatacccacagcagagtgtcagtctggaccccaccttgctggggtcccaggctgaatcttgctgcaaggtggggcactcggggtcactgcccctggcagccccacaagtcctgagccgccttggatctcagaaatcctaccatcctaggattggccctctacactgaattctccatggcttcaatcatctgcgtgagcttgggcaagttccttaaacctcctgagcctctctttcctcctctttaacaggagtagggagctcgtgtatgagaagcgcttagaccatgccaggcccaggttgcactctggctgagtagttggccattgtcactgttatcactgtgataggttttaatataatttactgtctgcttcatgccaagccctaggaaatcattagcaccccattttgcatcactaatgctatactttttgaaaaaatcgactacccatctgattactgtcctcctgcccagccacttccccagcagaatcaatggatagcgttttgactgttctctaacgctcacagcagccccaagaggggtgagtaaactaaagctgggaagaggaagccgcttgcccaaggccccacagccagcagcaggtggcctgcctcgcgcattcccccacccacacgtgccacttccccagcaccaagccctgggtctggcagcaggtagctcagcagcagctcacacacaagcttgtggatgggtctttcacgtggcctttctgtccctgcagacctgggctccagcagtgtgagagctggcctgcagtctctggaggcctctggtcgactggaagatgagtttgacatgtttgcgctgacacggggcagctcactggctgaccaacggaaagagtgagtggcctggccctgccctggtcccctgcagttcgggtggctctcggggttctggaacccggttttatggtggcacaccatgaggaagggcacacggaccctgcttagtaagcacgcccttagtatcccctaagtcagtccagcatggcctgggagccctgtggtcagttgacagactgcgctccccacaggccatgctgggtgggggagggggagcctaatgacccactgtatgccagaatcttacatagtctgatcagagggggaaactgaggcacagagaggggcaggctcatttgccccaggtcaaggagctaatatttggcagcactaggttaggagcctagggctgtctggttccaaaacacagtgtctccaccccccgcccccctccctgcactgtgtaccgcatagtaagccctccaggagcagggaagtttcctgataaatcctcagggactttcaagtcaagtctttttctgttgttccatagccaccgttaatttccagagaagattaagcaggttctgtcagccttgccccagagctggggctctgcccttccctgtgcaccgtgcattttcagggggtactttcagcagcataggcacgtggcctgagtgtgtccaccagggtctgaccccttgccgggacctgcgggagaactggccccgtacaggcttgtaagaggaacagtctgcttgatgttttcttcagccttttgcccactgtgacccccagggctgagctgtgggcagccaggattcttatagctaaggaaagttctagattatgggatcttcccactgaccccactcagctccttagaggtcattctggtgtcttttggaactttgtcaatgggcctccagagagcccagggataacctctccacacccacaaatccaggtccaggctgtagcctgctaggtccttagggctgccctggctgttagctgtatctttctttagtctgggcagagtctgtacttttaagcccaggtaccctgggaccagcagctgttgccatggagttaggggtgctgccgaggctaccctgcaaaggcaagctaatgagtgtgatgggacttgcagccagacacgcccatccacagaggccccagcaggcaacactgctggccatactggagaaccctggcgcctgccctggtcaccagcctggctgaggtatgctgttgcgctgtccttcctctggggagcaggctccgggggacagggaaaagcacacaaggaacttgtcctctagggcctgcagtctcatgggagagtgacatgcaccaggaccaccgctgtgaagggctaagtgctgtcctggagggggcaccaggctctgtggacacagaggagggagcatgcaactctgcggagggtactcagagctggaccaggtgctgggtgataggaaggccatttcaggcactaggaacagcatgtgcaaagtctcagaggcagggcgggagagaggtgccctggctcccgcacagcagctgggaaagatgctcttcacacagggaagggggcaggatgctgagagggtggtggggcccactgggctacagagaggcagttgattttattctaacatgagcaggagggagcacaggaaggatcttttttcttatcagattttcatctttgaaactgccttcagctgagcacagctgaaatgacatcatgcaccttctcaggccattggttctcctgcaggccctccccagggcttggtttccaccctggcagaaaacatccagcaaggtcaggcgtggacctgagcatccatttcgtcttccctttgttctcctgcctggctggcccccttaaatgcttctggtggatcttccagctctggtcacctgactggccttttctgccagcttggtgtccagcccgctcctccctgtacctgcctggctccccacttcacaccagcctgcaaccagctctgccctggctggcagggaaaccagctccttatcagccgctgtttctgctccagccttgaccacagctggcaccgtcacagccttcctgcagccagtcctatccactcaatgccaaggagtagcagggcttctgggcgagccacagcagagacgcctcggctaggccttcacaaaggcaggggtgtccttcccccgctttgtccgcatcttcgtcagtgctgctgtacacagaggccttctctacaaggagcacttagacaagtgtcaccccagtggcccaggtgcagcccctgcccaccagccccactgggaccacctaaggagtgaccctccaccctcctgcactgggcagggggcagcaggccctagcccaggggtcaccacccagtgcaggaggtgcgggcttcctccagggaagtgcttggccctccaccaccacaggcatggccttcagggacagctgggcttcagggccatgtgtgggcaggggtggcgaggagctaagcttaggaagggcagatagttcttttttttttttttttgagccggagtctcgctctgtctctcaggctggagtgcagtggcgcttgcagagtgcaagctccacctcctgggttcacgccattctcctgcctcagcctcccgagtagctggggactacaggcgcccaccaccacacctggctaattttttgtatttttagtagagacggggtttcaccatgttagccagcatggtctcgatctcctgacctcgtgatccgcgcgccttggcctcccaaagtgctgggatttcagccactgcacctggcccagatagttgttttgagtgaagggaaatcatgggtttctgcgtgttctggggctgggcatggcttcttcagccttgcccacaatgcgccaagcatgtcttagagacagcaacaagcacctccagaccctcaattagcaggccttctctgggtcagaagtcagcaacctgacgccccacctcccccgccactggctttaaggttggctccagcagggccctgccgtagtcactggcccacttgccatggatgggagccgtgtaaccagggaatgccccagctagtggtcacactccaccagcaaactctgcccctggtgggaaggaacagacagcagcactcttcaaaatgactgcgtgggaactgggggtcatattcaagaagcccctttcagtgccagcctactccattcctcagaaagcaagctggtattgcaagagttaaatgtgatgcagtcccagttcctgaagcctacagttagaccagccccgcttcactagcgtgtcaggtggccttgttcctaacaggaatcgcaggcctttccctttgtgaccagaattctgtggcttacttctttgcctcaaagctgcactgagccagtgctgaagtcctgtctgccggcagttcagggcgagaataacagggctctttccctgcaacagggctgggtccccaacacctgccctgggcacccccactgcggcagctgggaaagacaccatagccgcctctcctccttagccagcttctcctctcactcaggttattctcttgctccccaggagacttaacctcacacacaacatacccttccttgcctctcctcatctgcccagcaactgtggggtcagcctctgccgctcccagcccatcagccttgcgtgccctcccagttcctgcctccccaccctgcctagctggctggcaccccccagaggacatttagaagagctgtaaccaagccacctcccatgctgctgagacaaggtgggggcagagtcatctttgtgctggtgagccagtgcaagacaagatggcacctcacccagcagtttatagatgtgttttcagcagcagaatggaatcccccattcaaatacgacctcatacacaaccacagtctataaaataggaaacaagatctgctcaagaaagggtctgctgggaattctccatgagcctacgggcactggagctatttatcagtctcctgagtttggccaatcctggtcatagccattggtggtcttggtctcagtctttggccagcaacaccctccctaacctctccagcctttgctgctgtctgtcatgtaggtcacttgtcagatcctaatttccagaggcaggaaatgagaccctttttaccatttccaggcaggcctggaggatgggagccgtcaatctgtgccccccagcccgctccgttcttgcatcagccatcggtaagggcagcatccaatggcttggtggtctctctttcagggtaaaatacgaagccccccaagcaacagacggcctggctggagccctggacgcccggcagcagagcactggcgcggtaagcagaggggccatcctgccaccctggggccctcctgaaggaggtgagggaatgctcacccactgggtgccgttgtgggccaagcactggcccagcacgtccacaggcccttcctcgtttggccgtcaggtcggttctttttggctagtgtggttattcccagtttatagctatggaaactgctagagaggccaggccatttgcccaagcccacaagcaaggattcagacctgagcctgacttgaaactggagaccaggccgggcgtggtggctcacacctgtaatcccagcacttcgggaggctgaggcgggtggatcacctgaggtcaggagttcaagaccagcctggccaacatggtgaaaccccgtatctactaaaaatacaaaaattagctgggcgtggtggcacatgcctgtaatcccagctactcgggaggctaaagcaggagaatcgcttgaacccagatggtggaagttgcagggagcagagattgtgctactgcactccagcctaggtgacagagcaagactccatctcaaaaaaaaaagaaagaaactggagaccagtggcccgggcttcacattccagctctaccagttaccagctatgtgtccttaagcaaatgactggcctttctgaccctcagtctctttatctgtacattggggcttatcctagcacctatacttgtttataatagaagtgtgagaggatatatttagggagctttacatggagttagagcccgttcaatagtattcctctctgcctctctagagacttttaatctgcaggagtgtgggcagagaggaataaaagagcggaccctggccaggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccaggaggcggagcttgcagtgagccgagatcccgccactgcactccaacctgggcgacagagcgagactccgtctcaaaaaaaaaaaaaagagcggaccctaaagcagcggggagaaatgcgagggtgctctttgaattccgtttagttccttgactgtgtgttgagtgacagccacttgtccagcaccgagcacattttgtgggtgacccccacacgctttggcaagacctccaagcaccattctctcatgcatgtcaacgtgtatctggatgcttttcaggcagtgtgagaatttctgctccagcaagtgagcagacagagcaggtcccatgggagacagttagaaacagccggacctgggagtccagggagtccgggggagtgagggtggtggacctggggccgaggaggctagaggaggctcaaggcagcatggggacttctgaggctagcatggggttgggggtaggaagtgaagctctatgggtatatagcagggaccagaggacctcagcgcggctaggagcgctgcagattgcatcctaagtgaggtggaggccgcggggaagtcttgagcacaggagggacttgacttccaatctgaaagatcaggatggagctaggaaagcagggagggccgggcacagtggctcacacctggaatcccagcactttaggaggccgaggtgggcagatcacttgaggtcaggagttcaagaccaacctgggcaacatggggaaaccccatctctacaaaatatttaaaaattatccgggcatggtggcgcacacctttagtcccagctactcaggaggctgaggtgggaggatcgcttgagcacaggaggtggaggttgtggtgagctgagattgcactacgacactccagcctgggcaatggagtaagaccctgtctcaagaaaagaaggaaagcagggagggacgagttgtggaaaccgtccaggccagtccactgtgggcaaagtcttcgtgacccccaagggcactctctccgctcctgggtctcccagcatctcaggagccattcccaagtcagaacagggcaaggtggaggacgctggggtgggccatctgggcctctcgtggacagaggttgactctaccacccagtgggcaacaagagaatccagtacctcccatgtgtggtgtgtgacctgccaccaagcacagcacattgcacacccgtgtcacatccaccgcacacaccagtcagagactccagtcctttttcgggtgtaagccatcatttgctgagcctgtgctccgggccaggcctgcactaagcactttgcatcccctctcttagtgagtcatcacagaaacccttagggtatgttattatcccgttttacagatgagaaaactgagttccaggaagagcttaagtgaaaccacaggtgtactgtcctcggtatggtgcctggcacacactacggtattacggcacttacgcttcgcagtaccgccatgtcctcatcccatttacagatgagaaaactgaggctgaggacagggagataccctgcctagggtctcgtaggtattgttctgcctggcttctaagccatgctggtaaccttagagctgtgaaaagccctaaggtgcaaaggagagtgagtggaggtgtgtgtctccctcctcagcctcaggcttccagtgtgtcgggattcatcggaaccaacacaccgcgagcctgctgtaggagctcccctctcaggccacctggcctctcgtggtcagaggttgactccaccacccagtgggcagcaatcccagccaatctgctcctgctgcagcccagagacagggttcacttccctaggggcacacagcaattcaggcgtgactaaaactagagcccaggtgtcctggctcccacactaccttgcagcccgcccacagggaggaaacgcaccacacaactccactggcagcaaagagaagctgataaaccggttatcactgatttatctccgataacctgggagatttaagccacttctgccaaatcagggtatgatttcttaaaactctgtgagcaaatgcctgctcctggggtgctggagtttggctggtggtaaggccttcacccactaaaccgtgagaacatgattcccaagagcagagtacaaaacagcatcaaaaccaggcgcggtggcaggtacctgtagtgccagctacttgggaggctgaagcgggaggatcacttaaacccaggagtttgaggttatcgtgagctatgactgtaccactgcactccagcctgggcaacatagtaagactgtatctcaaaaaaaaagaaacagaatcaagtgccaattgtgcgcagcccaggtttgcgccctgggattcagagcaggactcacaagtcgtgtgacgaggtggtattgcatgctgtgtgccaggttttagttccttcactccctgacatgcctgctgtgtgccctgtgccatgtgccaggccccatgctggtctgagtagggtgaaccagccaggcacagggtgacgggctgggagcaggactctcgtctccctccactctggggccctaggaaactgcatgtgtgccatggatgaatgtgagaaggttggataaactgatgtttctaaaacctgggtgcctgtcagaccctactgggagcccccagaccatctgacagccgcctgccctgctatcctggggttgctgaggcccagcctctgggatccttgtggagagagttgagaagctttgtttagtttgctgtcagctctgcctcagcctacccagggcgctggcatcccagagctgttgtggctcaccccccggtgggtaccacaatacctgcctcatccctctacaccagccgccacatccaccacacacacctccacacaccacacctccacccatagacctacacacacaccacacacacatctacacccaccacacacacctccacacacacctacactcatacacctacacagacacccctacacacacaccacacctacacactcatgcacctacacacacccctacacacaccacacacacatctacacccaccacacacacctccacacgtcatacctccactcatacacctacacacacccctacacacaccacacctacacactcatacacctacacacccccacaccacacacacatctacacccaccacacacacctccacacaccacacctccactcatacacctacacacagccctacacacaccacacctacacacccatacaccacacacacccacacacaccacacacacacatctacacccaccacacacacctccacacaccacacctacacacaccacacctccactcatacgcctacacacacacccctacacacaccacacacacatctacacccaccacacacacctccacacacctccactcatacacctacacacacagccctacacaccacacctacacacccatacacctacacacccccacacacacaccacacacatctacacccaccacacacctccacacacacctccactcataaacctacacacacagccctacacacaccacacacacatatctacacccaccacacacacctacacacacacattcatacacctacacacacccctacacacatcacacctacacactcatacacctacacacaccacacacacatctacacccaccacacacacctacacacaccacacctacactcatacacctacacacacccctacacacaccacacacacatctacacccacacctacacacaccacacctatactcatacacctacacacacccttacacacaccacacctacacactcatacacctacacacacaccacacacacatctacacccaccacacctacacacacacccctacacctacacatacacacctacacacaccacacacctacacctacccacacctacacctacacatacacacctacattcatacacctacatacacacccctgcatataccacccctacacactcatacacctacacacctgcacacacacccctacacacaccacacacatctacacacaccacctacacacaccacatacatctatacctacacaacctacacctacacatacaaacctacactcatacacctacacacacacctacactcatacacctacatacacacccttacacacctacacacacccctacacacacacgcctcccaaagtggcagcaggcctcctgacccgaaaggcgcacccctgttagaagccgcgccctccagtggccctggcgctgccgtccctccgccatcagcgtgactctctctcacccagatgggaggcggctgcgggaaaagcctcagtgactggatggtgagacaaggcatggtgagcaggggccaggcccggccacccggaaagctgggggtgctcgcagggctcctgccaggcatgggcgtggggcaccgtgctgctctccaagggagtgggacccaggagaaggcccagaggagcaaggaggggcagctgagggtcttgcgggaccccagggctcaggctgtttccgggttggcccggccagcccagcttccgcagctcctctgtgcccggttcctgctcttgagtctcgggcaaggacaaggtagcccgtctggcagctaagaggcgatggggatagcggagcgggagacggagccggtgtgcacagctgggcacttgctgttgccactgctgctgggaagtcggctcctgccttctctctgggctctgctcctgcctggggggtcctcaggtgctgggtgacagagcttggaaaccaaactggcctggttggggaaagactctgtctgtcttttccaaagtagctcactagtaactagtgctattagtgccattactgattaatagtaaataggaactggcctattggtttcttgagcatctcctccatgccaggccctgtgctaagcttttgacatcccatttcatcctcacagccacctggacggtaagtactgctgctagcctcaccctaaggacgagggaaatcaggcgcagagaagttaagtaacccactcagagtcacactgtgttaaggggtgagctaggtccagctctttctcactctgaagtctgtgcccatgacctccaactggagtctgcccctgcagaagccgttagagaggaaagcctccaactcctgcccctgtgtgggagccatcgtggcacagcccatgtctttgtggccgaaagtgaaatgtccccatctgtagcaccgcccctctgggtctacccacctggccttgtctggttaacttcgcgcctctgctctcaggccctgctatgcccccttctatcatgaaatctgcgtctgcagagacaccaggggatggaacctggggacccctggcccactaaccatgtccccatcccagccttcacggctggagaaaatgcctggggtctgaccctgggcttggcgtgtcttttgtcagatgctcctgagcacctgcagcatagcccctgccccaggccattgcccaaagcccctcctccagcctagaatcctacccgaagggtgtgtcggaactggggttcttctcttcaaggggaaggagctccctctgacccctggccctgctccagctgctgggagcctggtcccctgcttagtctcctggctctgcacctccatcacccacagcctggcacagcgggcccagtggtgggtccgggcagctaggcagctgaggctggggtgggaggctgcccagggccacccagctgcagggtgctgagctggcacgtcttccaccttgtcacctagggcactgccttaccctctgcccttccttccagatcccagtcacccaggcctgcctcatggaggacatcgagcagtggctgtccactgacgtggtatgttggggcccactcctcacccacacagcaggaggacccgttgttctcaccaagaaatgacccatggggccagggtagacttatatagcatatagcaccctgagagcagaggggcacacttaaagtccccatctcctgccacctgcccaccttgtgtttggcacgccccccagagaagtcctgggcacagtagcctctcggctgcttcccagagcctgctcccaaggtgaggtcccagtgggtgtcagcccaccttagggacatcaggccaggctagagaggctaaccgaggaagcataacagcgccaggctcttacctgcagtagctcagaagactccagccacttgcagagggaacccatcaccaccctgtttacagatcagaagaccgataagcagctgtcctctaaggggaagcacccaggaggaggagggcgggtgccagtcatggggaccccaagccctgccaccctcccagggagcagaaggggcagggccagactcagcttctccgtccagggctcctaccgcagcatctgccaccccgtctctgggcaccaaggcccacatgggcacttcaggcccagaagccgccttctgcaggtgaagagaccatttctgcccaggactaagccacagaccaaggactcaggctttctgtctggtggcagaagcctcaccccctccctagtttgcagtgttagcatgaatggccctcagcctctggatgtcagcctttcccccccaggggtgaggaccacccaccccttgtgaccctccaaggaaaggaaccagcactcatcaaggtcccactgggcaccaggtgctgggcttggcgtgctgtgtgttatcccatttcagcttcccagcaaccctccaagttagcttcagcccccaccccgcccccattttacagaaggaaaacacaaggctcaggaagtcaggtgccacccaaggaaggtcctacggctcagggaggagcccaggtccaggtcctgggacctgggtggtgggggcgtgcagagcctgagctgggacccagtgctgaggttcagcggggcccgagctgcagcaccactgccccaggctgaccgtactgggggcccggctaacctctgcctcctttccttctaccttcccagggtaatgatgcggaagagcctaagggggtcaccagcgaaggtagtagtccccgcccctgcccgccctctcctttccccagggctctggcctcagggcctaccctcaccctctccccttcctctagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaacca

SEQ ID NO: 8127 - DNA, 17522 bp, mus musculus; identical to SEQ ID NO: 8126

SEQ ID NO: 8128 - DNA, 17522 bp, mus musculus; identical to SEQ ID NO: 8126

SEQ ID NO: 8129 - DNA, 1029 bp, mus musculus
gaattgccttctacagaggcgaattatattctgtagaaactagctagccaccaagatgttaccaataaaggattccttatactagcaactaaccatgtttaaaaggccttagccatttagagtaatatttatgagtacaagcataattggttccttgccttctacagataatcatctataaaatgataaaagcaggcttcaactgtgtttcttctctggggtgagaaggtgcagatacacatgggtgatctactgatttaccttctgaaagtactctttggaagcagctggatttggcttgattgtaggagaatccagtgtccagtttgctgggcagacttctccatgggtttctacatactggaacgccttcaccaagtggagggtttcttccacgcttcggcccactgggaggtcattgacgctcaagtgcttgatgactccattggggtcagttatgaagagacctcttagtgcaagaccagaaccttctaacagcacaccgtagtctcaggaagtttgctcaaatctgacaagagtgggatgttcatgtggtccaaaccaccattatttcttggtgtatttatccaggcaagatgactaaagtgggaatccactgagaccacaacttcacagttcacatcatgaaattccttagctttgtcactaaaagcaacagtttctgtaggaccacgaaggtgaaatccaaaggatagaagaaaagcaccaaattatttccccttaaagtcatcaaggcttaggtctttgaactctccattgacaatggctgtacccttaaaatagggtgcatgctgggcgacagcaggtgcatggtatgaggagctggtgctaaagaattttgcttgactggaaccagaccataatatgtttgtcaagctcgttcttccagaagcagcaagcttgagggctgcagtggcagaaatgccccaaggaatggcactcacatgtcgggcagccgatgctcagagtagccttcccacagcagctaccatcttcagtgcacgcggg

SEQ ID NO: 8130 - DNA, 562 bp, mus musculus
tgcttttaactgggggagggaaagtaggaagagagccttatgtaatgacttttggttcttctcagccacttaggattggcatatctgcctttggcagtacagggccaggggtggggtgatgcccatgggagcctgtctgcacagggagggttggctagcggatctaggagggaattagggcgttccttgaaatctttgtgttcctaatatattttggctgtgagttgggctacacgctgctatcactaccccctcaaaaaaaccaagaaacaaaacgccgtagagttaatacttcattcccacaacatatactccctatgcatcaaacactgcacaccctggggatgcagcagtgaatgagcccaaatgtcccccagaagcatatggtctgggggttaatggagtggagatgggaacaaggtgtggagcaagtacctaggacccctgtagattagttctccgcaccgcgtgatctcagggttcaaatcttggtcacatactttactgacacagtgaccttgggtcagttacagaaactactcagtttcttcatcctttaaat

SEQ ID NO: 8131 - DNA, 1087 bp, mus musculus
ctcctttcctgcacgtccccccgcccccgccctcgctgcctctctgctttgccctgaacacccccaccttggaggttcctgggattagccccttggcgaggatgccgagctggccggcgtgttgtgttggctttgcgtgcgccacgccgagaggctgactgtcttgggccgcgggaagtgggctgtcattaaccactggctccgtgtttgtcccttacttgtgttttagagaaggatgaggctgcaattgagcgctctcagttcaatgccacgtcagtagctgatgtggacaagcgggtgaaacggcggctactcatgggtaacacttttcttccacttcctttgtcgtacttgcacttgtgtgtgtgtgtgcacatgtgtgtctcgggtgcgcactggcatgtggacatgggcgtgtgtgtgctgtgtgtgggtgtgacgtgtgcgtgtgggggcatatgtctgtgttgtggggtgtgcccacgtgtgtgcagtcctgcgtgtcgtgtgagtgcggggggctccactccaggtgtgaactcactttttcctttttaaagtttttaccctccatcaaacacatttgttcgttgtttgtgtgtttgtagcaaagaacccagggctagtatccactggcctgtgcgtgtaaggagacgtgtgtcgtaaagctccccgacttgcgtgaacacccacattcacagttaggattcccaggctcagcaaagcagcactgagactcagccacaaaagagggcatttgagtagacgggtcagggcaggagagtccttacccatctccactcctgggagggaagctaccggccaggacctccaggacctctcagggaaaaagccacctacttctcagaggctgctcaaggtgttttgggaggcctgctggcagggctgatcaggcaccgatgtgaggagaacgagaaggaagaggagaaatcactgctcttggacagagctcagcgtgcacagtggaaagcagacttcctcatctactcgttcttctctatcagtcggttctgctgttttgctggcctctgggctttgccagctgcccaagacctcctgagcgtag

SEQ ID NO: 8132 - DNA, 490 bp, mus musculus
tctgggcagcccacgctgccatcaccaccattgcagtgctctttgtagccactgggtgtcagtgtgccctgagaagtcaacgcggcttttaggagctctgttgaattgaccctttctgaaataattttcatatgaagtggttacatttacctttcagctttacttccgtctcttcaggttaaatctaaaaaacacgtttcagagattaatttcaaaatatggtttattccgggaggaagcagcatcctaagcacgtgacatttaaagaccaggctataaggaagtgcctctgcccccaggccaggtggcagctgttcagatgtttattatggacagtgagctctgaacggggtcagcctggcaccccgagtgtggaagacattttcgctcagtgtgaggccttgtttgaggttggtcatcaatattggaatttcgtgaagttggagtgaggttgccagatttaatcttcatttctaaaatttggtagctg

SEQ ID NO: 8133 - DNA, 1214 bp, mus musculus
ttcgcagcaattacaccgccttgttgggagtgtggatctatggatttttcgtgttgatgctgctggttctggaccttttgtattactcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgaccttccagagttcgtctgcctggtgagtggctacaattgagacccagaatgatttgggtcattgtctttggagagcttggagaatacgccatcactctcgccatagtgtttggctcattggttgcctgattgtttgcttatcttgttgtttgccaagaaaaatttcaaactgttatgggtagcctacaacacatgcctagacaggaaagtcaaaatgagaggtggaaacagagcttagaagcaaagcttgcaagctcattgcgcttagagcccagtgtgagagaggtaaccactaaacatttagtggagttttgggttacctagctgccaaggcaaaggggaaaaccggatggctttttgagttgtaaatctggccaaaggaagcaaatcagtctgtccagccagatttttcagcatgaggttagaaaatacaaatgttacttagttccttatgtgtacatgccttgtatggcatgaggggtactagttctgactcaggcaggctgtgaaggaaggaaggaaggaaggaaggaaggaaggaaggaaggaaggcaggaaggcagagaggtggcatctcaagggttggccttgtggggtggctgccccagggttatgttcagatctgagcttgtctactgcaattcccatttccgcccagttccagtatggtggggatgggcctgacctaatcccaggcggccctgggtagtgcagcatctagagttggaaagggagaggcagggtctgtgcgtttggagcaggaactccctgggaggctggctagcaccaaggacaggagccagactgagggtcgattcccaggtcaagggctagagtgagaggttcggatgctctgtgggggctgagctgcagccatgggcacacagggctcagggcacgtcatccaggga

SEQ ID NO: 8134 - DNA, 2940 bp, mus musculus
tgaaacaaagacatatctgactgttgcttgtggaggtgcctgccattcctccctacagtgattcacaggctcacccagcctctccttctccttcaagccccaaacctctgaatgccaggaagggtggtaagaagtgtctctgcgcctagtaccagtaaagttggcaggtcactgtggctagcgggggcaccattgttggcctcgggcctggggagagaaaaatatgacatacagggggcccacgggggtacgttaggttcagccctgtaagcccacactgaccctggtgggcagacccagcccagggaggggcaggcaggagtgaccccgtcatcaggttctgctggcgagcccagggtggtgacaggcgcacgtcttttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccgaaggccttcctgacccctcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacttgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgttgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctggacaatgcacaccctccatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgatgccttggcagatgctgggcatctgaatcgtgcagtgcaggagcacaggggcatggcaccgtttgttgctggggaacctaggcctcaaaagggcctcagcctctccgcagtgcagtgaggactgtcccatactctcactgcgtacagagtatgggagagtctctgtgaggctttgggtgccctgcagagggaaggcagtgccagctgggcctggtcgggggccatggagatggcgggcccaggctggggaggacttgtggcacccactcccttacccgctaacccggatcccctggaatctgcagaatgcctggggttgctcctcttctaccctgccgtggctgagctttgtctgtgccctgtcctctggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagcctccacagaggcatgcacagcaaggggtccggaggcatgccccatggagaactgggggtgctctgcttgcaggaggatccagggcccattgcagtcctcagatgttctgggggagaggatacgcctgcttcatttcttctcaggggtcagaactgggcacagggggttggaaggagggagaaagatgtctatcaggtacccactgcatgccaggccctcttctaggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccaggcatggtggcacatgcctgtaatcccagctactcgggaggctgaggcaggagaatggcttgaacccgggaggtggacgttgcaatgagccgagatcacgccattgcactccagcctgggcaacaagagtgaaactccgtcgcaaaaacaaaagacaaacaaaaaacacctgtcaggtaaatggtggtagagcagaaaacctgggctcagaagctggcattgatcccagagccatccagtttcaaagcccacacccacaactttcctccaggttgggcagtgcatgatggaaaggctgtcccagcaagtagtgagttcactttcaccagtccctggaggcaggagcagagcctgagctgaccacttggaaggagatgttattcaggggactcgagcatctggcgtaggatgggactccatgaggtctatgcctccttctagctctgaaactcctcaagggaaacc

SEQ ID NO: 8135 - DNA, 1107 bp, mus musculus
cccttctccttattttgcatcctggggttccagggacaaggtccctcccgggccgcctcccaccctacgcacttctgagcctcaagggcacccggtcccgggtcccgggtctagaccggctcatcgcacagagtagcagagccgggctcatcgaggaggcaggaggggctcgccagcgtggcacgggcgcccggcgggaacctccacccgccccgcggccgcgcgtccccgcctcgaattcagccccgccccggtgcgccgggctggaggggcgctgacgctcagcggtgtcccatcggtgaccttggacggtccctccacctctccggcctcagtttcccttggctgcagcggccgcggggcgctaggtgggagccgctgagcgctcccggggccccgcccaccgcgagcagccaatcgggcgccgccctccggggggtgtgtcccggggccgaggcccggggcccggagggcgcgcggggcgggcggggcttccgggtcgggcctcgggacactggctcgcgcggaccggggcagggggcgggccgaggggcggtgcgtgtcgcgggggcgcggctggcacggacgcgcggaggcggcgccgggcatgggccgtggacgcggcggccccgcggcgggggcagcgggcggcgggggcggaggcggccgctagcgccctgcccggcgccgcctccttcggcgttcgccccacggaccggcaggcggcggaccgcggcccaggtgcccgggggcgggcgggcgggcgggcgggaacgcgcgcgggggtccgcggtccgggcttcccaggtcccgggacccggagggcggcggacgggggaggggcaggggctgggcggcgcatgcgcggggcccggggtctcggggtctccgggtcccggggacccgggggcccggggtgcgcggctggggacctgagggcgaggagcgaggacacacaccgaggactcttgcgagggatctcggggcccagctcggcctccctcctagcgctgggggcctgcccggaacccgagtccgcggctgtccctggggtttggcgctgcgcggaggtcgggtctggggaccgcagcgactctgggtcttcgg

SEQ ID NO: 8136 - DNA, 1142 bp, mus musculus
tgtggccatggcagagcccttgggcagctgaggcccgcagcctccctggcctcatcgcccatagcccctcctgtggcttctgatggaatctgcaggggaggggcgctgagggcgggtggcccactccatcgagttaatgcacacagcagccagcaaagggccacatccatcgtgcaggcgcagacaccgagcagagccccaggaatcaattaccaggaggccgcagaggctcactgggggctggctctggccacagaccatcatgcaccatcccatttaattctcagcagccagtgaagggtccatgtgaccctgcctttgatggtcagcgcctccaggggtgggaggctgagcctctgcccaaagcggctcagctcaccccggcagctggaggtgggcccagtctcctgaggctgaggcccattccccctgctctgcttcctgcctcccccaaagaagacatctctgcaggaggcttgcagcccaccttcgagggcagagcctgggagcccgtcctccgggggactggagcaggactcgctccgggcacccttcctcctgggcttctttccaccgtgctatgttcccggctcactgaggccggtggtccctgtctctgagtttatcagtggccatgtgcaaatatgggccatggtgactgggcttacaaagccaaggtgtttaacctgggctggcaaatcgggagggagaggggtaaaagtgtcattcagtaaagaaggccaaataaggatgggggatttgagctgatttccaactgcaaataggcatcaaatccaggggcgacataagggagaggagttccaagactgaggtggttctagggtgtgggatctgtggccagtggtgtgctacagaatcaaccgggccaacatgttaagtccccgacatgcccctagcacactagtttgggtatattcataggtgctatttttaaaaaattagtacatgatgagttgaacagttaaactgactttttaaattgcagaatgtcttggagctcttgcaatactagtgtgcacagtcatctctaagaaaggggcattgcctgctctgattcacaaacttattaggccaggaaccctgctttctggtgtctcctgtgggatgcttctggaagatac

SEQ ID NO: 8137 - DNA, 992 bp, mus musculus
atccacagttcaacctcactccttccttacttcccgccccgcctggcctggttttttgcttctctccttgccttacccactcatcatgacgctcattttgaggtgaagcttgtttatgtccatccaatgcaagcccctgggggcagggcttgtgtctctctttgttccgtgctgcattcccaggaggcagccaccgtcaggatggtctggtgtctgccttggaaggagggaacaagaggactggatgtcctggtgctcagacgccagtgccccagaggctggctgcctgttgacagtgtgggtgccccagaggctggctgcctgttgacagcgtgggtgccccagaggctggctgcctgttgacagcgtggatgcttggtaccagtgcctctgggtctgcagccttggccttggccttccctgacacaaagcccagcctggcccaccgtggacacacgcagagacccaggcatctctctcagcccagagcctgggagggggcagcacagggagcagtccctggacacccagagtgacttcaaggagctgaatcttattaaagaacagacagcattgaaaaacaatttgatgtcgatgaatgttcacccccgccccctccccgccacgcattttaacagccactgacactgcaccttccaaatccgttttattctggtttgaacagctctactccatggaaatggcttaatcggattcctctgttccttccaggcaggcaatccagggtgctgtgtttactttccagacttgctagactgtatgaaaacagacagcttgtacctgtgccagtgtggcgtctgtattttgggcagggatcgaacataaatagactattttgagggtgcctggccagacttttcttccttccccaaaccccatgtgccaaatctttctgcatgcagctaattctatagttagtacttgcctctctcctatgatgctattatttaaagcttgatttctttggagaa

SEQ ID NO: 8138 - DNA, 1081 bp, mus musculus
gcccggggacggggacagcaaaggagactcgtttggaccctgagccaaagcgaggccctgtgagcctgatttgagtggaacccgtacccgggcattacgaccagagaacagctggcccaggccatcggcattccggagcccagggtccagttttggtttcagaatgagaggtcatgccaactgaggcagcaccagtgggaatctcggccctggcccggaagacacggccctcaagaaggcaggcaaaagcgaaccgccggcacctgatcccagacgactggctcctccgagcctttgagaaggatcgctttccaggtattgccgccagggaagagctggcaagagagacgggcctcccggagtacaggattcagatctggtttcagaatcgaagggccaggcacctgggacaggctggcagggtgtccgcgcaggcaggcggcctgtgcaactcggccgccattgggtgtcaccctgatccctcgtgtgtcgccttcgcccacaccggtgtgtggggaacagggcttcttgcacaccacgtgtaatgcacgcctggggctcttccacaggaggctttcttgagacagggagtgagggccgtccctgtgctccagcccagccaagccgcgccggcagaggggatctcccaacctaccctggcatgcggggattttgcctacgccaccccagttcctccagaaggggcgctctcccaccctcaggctcctcagtggcctccgcacctgggcaaaagccgggagaaccgggacccacagagagacggccggccgggtccttgcgctgtgggacagcctgggccagctcaacggggccacagggccaaggtgagcttgcgccacccgcgtcccaggtgagtccgtggtggggctgggccggggtcccaaggtcgccggggtggcatgggaaccccaagctggggcagctccacctcaccagcccatgcctccagaggcctccccacagcaggggcagatgcaaggcatcccggcgctctcccaggtgctccgggagctggggcgctcttctgcactcccctccggccagctgctggatgagctcc

SEQ ID NO: 8139 - DNA, 25 bp, Artificial Sequence
  synthetically generated PCR primer
cgtgcatcgccggtccatccggtaa

SEQ ID NO: 8140 - DNA, 26 bp, Artificial Sequence
  synthetically generated PCR primer
cgctgccaccgccatcttggtttgtc

SEQ ID NO: 8141 - DNA, 20 bp, Artificial Sequence
  synthetically generated PCR primer
cggttcttccgtggtttctc

SEQ ID NO: 8142 - DNA, 20 bp, Artificial Sequence
  synthetically generated PCR primer
ggtaagtccaccatacacac

SEQ ID NO: 8143 - DNA, 21 bp, Artificial Sequence
  synthetically generated PCR primer
ctcgacagcccaatctttgtt

SEQ ID NO: 8144 - DNA, 20 bp, Artificial Sequence
  synthetically generated PCR primer
accaacacttccacttagcc

SEQ ID NO: 8145 - DNA, 20 bp, Artificial Sequence
  synthetically generated PCR primer
cccaataggtccagaatgtc

SEQ ID NO: 8146 - DNA, 20 bp, Artificial Sequence
  synthetically generated PCR primer
ttttggtccttttaaatctc

SEQ ID NO: 8147 - DNA, 20 bp, Artificial Sequence
  synthetically generated PCR primer
ctcgcctccgccatccaccc

SEQ ID NO: 8148 - DNA, 20 bp, Artificial Sequence
  synthetically generated PCR primer
cttgccagctcctgtctcac

SEQ ID NO: 8149 - DNA, 24 bp, Artificial Sequence
  synthetically generated PCR primer
cagaatgacccttcacttttgcca

SEQ ID NO: 8150 - DNA, 22 bp, Artificial Sequence
  synthetically generated PCR primer
gcttgtgccaaacttgcactct

SEQ ID NO: 8151 - DNA, 21 bp, Artificial Sequence
  synthetically generated PCR primer
cgagtgcagcgagcggctcaa

SEQ ID NO: 8152 - DNA, 21 bp, Artificial Sequence
  synthetically generated PCR primer
gcaactggcacagccataggc

SEQ ID NO: 8153 - DNA, 23 bp, Artificial Sequence
  synthetically generated PCR primer
ggccacagcagtgaccccgaaca

SEQ ID NO: 8154 - DNA, 21 bp, Artificial Sequence
  synthetically generated PCR primer
cccggtgacaaggttggtgta

SEQ ID NO: 8155 - DNA, 27 bp, Artificial Sequence
  synthetically generated PCR primer
agcagcaggcatgcctaagcagcaagc

SEQ ID NO: 8156 - DNA, 27 bp, Artificial Sequence
  synthetically generated PCR primer
aggaagaggtctccactagtgtccagc

SEQ ID NO: 8157 - DNA, 22 bp, Artificial Sequence
  synthetically generated PCR primer
gacgatttctgtggctgagtgg

SEQ ID NO: 8158 - DNA, 22 bp, Artificial Sequence
  synthetically generated PCR primer
gacggaatgggcagctgtcacc

SEQ ID NO: 8159 - DNA, 23 bp, Artificial Sequence
  synthetically generated PCR primer
atgaatacggctacagcaacagg

SEQ ID NO: 8160 - DNA, 22 bp, Artificial Sequence
  synthetically generated PCR primer
ctcttgctcagtgtccttgctg

SEQ ID NO: 8161 - DNA, 23 bp, Artificial Sequence
  synthetically generated PCR primer
ggtaacaattttcccgccatgtg

SEQ ID NO: 8162 - DNA, 23 bp, Artificial Sequence
  synthetically generated PCR primer
ggaaataaacggaacgcagtacc

SEQ ID NO: 8163 - DNA, 22 bp, Artificial Sequence
  synthetically generated PCR primer
gctggttcgtctatcttgtggg

SEQ ID NO: 8164 - DNA, 23 bp, Artificial Sequence
  synthetically generated PCR primer
cagagtagcgaggacttgaagag

SEQ ID NO: 8165 - DNA, 21 bp, Artificial Sequence
  synthetically generated PCR primer
ccttctaactaccagcagatt

SEQ ID NO: 8166 - DNA, 21 bp, Artificial Sequence
  synthetically generated PCR primer
cctgtcactttcacctctcaa

SEQ ID NO: 8167 - protein, 9 aa, Artificial Sequence
  partial peptide sequence
VVDQQQVER

SEQ ID NO: 8168 - protein, 8 aa, Artificial Sequence
  partial peptide sequence
DQQQVERH

SEQ ID NO: 8169 - protein, 11 aa, Artificial Sequence
  partial peptide sequence
QEGSSGGAERK

SEQ ID NO: 8170 - protein, 17 aa, Artificial Sequence
  partial peptide sequence
KFYPLEIDYGQDEEAVK

SEQ ID NO: 8171 - protein, 15 aa, Artificial Sequence
  partial peptide sequence
VVSEDFLQDVSASTK

SEQ ID NO: 8172 - protein, 13 aa, Artificial Sequence
  partial peptide sequence
TTNFAGILSQGLR

SEQ ID NO: 8173 - protein, 13 aa, Artificial Sequence
  partial peptide sequence
VFSATLGLVDIVK

SEQ ID NO: 8174 - protein, 32 aa, Artificial Sequence
  partial peptide sequence
QIQAAAYSILSEVQQAVSQGSSDSQILDLSNR

SEQ ID NO: 8175 - protein, 18 aa, Artificial Sequence
  partial peptide sequence
VEMLDNLLDIEVAYSLLR

SEQ ID NO: 8176 - protein, 18 aa, Artificial Sequence
  partial peptide sequence
VGDTSLDPNDFDFTVTGR

SEQ ID NO: 8177 - protein, 14 aa, Artificial Sequence
  partial peptide sequence
KCPQVVISFYEERL

SEQ ID NO: 8178 - protein, 18 aa, Artificial Sequence
  partial peptide sequence
RIIGATDSSGELMFLMKW

SEQ ID NO: 8179 - protein, 19 aa, Artificial Sequence
  partial peptide sequence
KKVEEVLEEEEEEYVVEKV
